United States Patent
Fernandez Rodriguez

(10) Patent No.: US 11,208,437 B2
(45) Date of Patent: Dec. 28, 2021

(54) BRANCHED RECEPTOR BINDING MULTI-SUBUNIT PROTEIN COMPLEXES FOR USE IN BACTERIAL DELIVERY VEHICLES

(71) Applicant: Eligo Bioscience, Paris (FR)

(72) Inventor: Jesus Fernandez Rodriguez, Paris (FR)

(73) Assignee: Eligo Bioscience, Paris (FR)

( * ) Notice: Subject to any disclaimer, the term of this patent is extended or adjusted under 35 U.S.C. 154(b) by 8 days.

(21) Appl. No.: 16/726,033

(22) Filed: Dec. 23, 2019

(65) Prior Publication Data

US 2020/0199180 A1 Jun. 25, 2020

Related U.S. Application Data

(63) Continuation-in-part of application No. 16/696,769, filed on Nov. 26, 2019.

(60) Provisional application No. 62/783,258, filed on Dec. 21, 2018, provisional application No. 62/802,777, filed on Feb. 8, 2019.

(51) Int. Cl.
| | | |
|---|---|---|
| *C07K 14/005* | (2006.01) | |
| *A61K 35/76* | (2015.01) | |
| *C12N 7/00* | (2006.01) | |
| *C12N 9/18* | (2006.01) | |
| *A61K 48/00* | (2006.01) | |
| *A61K 38/00* | (2006.01) | |

(52) U.S. Cl.
CPC ............ *C07K 14/005* (2013.01); *A61K 35/76* (2013.01); *C12N 7/00* (2013.01); *C12N 9/18* (2013.01); *A61K 38/00* (2013.01); *A61K 48/00* (2013.01); *C07K 2319/70* (2013.01); *C12N 2795/00022* (2013.01); *C12N 2795/00032* (2013.01); *C12N 2795/00042* (2013.01)

(58) Field of Classification Search
None
See application file for complete search history.

(56) References Cited

PUBLICATIONS

Author(s) unknown, https://en.wikipedia.org/wiki/Bacteriophage, Wikimedia Foundation, Inc., San Fransisco, CA, downloaded Nov. 5, 2020, 16 pages as printed.*
Salmond et al. "A century of the phage: past, present and future," Nat. Rev. Microbiol., (Dec. 2015), vol. 13, No. 12; pp. 777-786.
Hyman et al., "Bacteriophage host range and bacterial resistance," Adv. Appl. Microbiol., (2010), vol. 70; pp. 217-248.
Chatterjee et al., "Interaction of Bacteriophage I with Its *E. coli* Receptor, LamB," Viruses, (Nov. 2012), vol. 4, No. 11; pp. 3162-3178.
Nobrega et al, "Targeting mechanisms of tailed bacteriophages," Natural Reviews, Microbiology, (Dec. 2018), vol. 16; pp. 760-773.
Flayhan, et al., "New insights into pb5, the receptor binding protein of bacteriophage T5, and its interaction with its *Escherichia coli* receptor Fhu A," Biochimie, (2012), vol. 94, No. 9; pp. 1982-1989.
Rossmann, et al., "The bacteriophage T4 DNA injection machine," Curr. Opin. Struct. Biol, (Apr. 2004), vol. 14, No. 2; pp. 171-180.
Zivanovic et al., "Insights into Bacteriophage T5 Structure from Analysis of Its Morphogenesis Genes and Protein Components," J. Virol., (Jan. 2014), vol. 88, No. 2; pp. 1162-1174.
Hendrix et al., "Bacteriophage lambda PaPa: not the mother of all lambda phages," Science, (Nov. 1992), vol. 258, No. 5085; pp. 1145-1148.
Speed et al., "Conformation of P22 tailspike folding and aggregation intermediates probed by monoclonal antibodies," Protein Sci. Publ. Protein Soc., (Jan. 1997), vol. 6, No. 1; pp. 99-108.
Labrie et al., "Bacteriophage resistance mechanisms," Nat. Rev. Microbiol., (Mar. 2010), vol. 8, No. 5; pp. 317-327.
Whitfield, "Biosynthesis and assembly of capsular polysaccharides in *Escherichia coli*," Annu. Rev. Biochem., (2006), vol. 75; pp. 39-68.
Meyer et al., "Repeatability and contingency in the evolution of a key innovation in phage lambda," Science, (Jan. 2012), vol. 335, No. 6067; pp. 428-432.
Gupta et al., "Coliphage K5, specific for *E. coli* exhibiting the capsular K5 antigen," FEMS Microbiol. Lett., (May 1982), vol. 14, No. 1; pp. 75-78.
Gross, et al., "Isolation of bacteriophages specific for the K1 polysaccharide antigen of *Escherichia coli*," J. Clin. Microbiol., (Dec. 1977), vol. 6, No. 6; pp. 548-550.
Schwarzer et al., "A Multivalent Adsorption Apparatus Explains the Broad Host Range of Phage phi92: a Comprehensive Genomic and Structural Analysis," J. Virol., (Oct. 2012), vol. 86, No. 19; pp. 10384-10398.
Tétart et al., "Bacteriophage T4 host range is expanded by duplications of a small domain of the tail fiber adhesin," J. Mol. Biol., (May 1996), vol. 258, No. 5; pp. 726-731.
Haggård-Ljungquist, et al., "DNA sequences of the tail fiber genes of bacteriophage P2: evidence for horizontal transfer of tail fiber genes among unrelated bacteriophages.," J. Bacteriol., (Mar. 1992), vol. 174, No. 5; pp. 1462-1477.
Wu, et al., "Characterization of Extended-Host-Range Pseudo-T-Even Bacteriophage Kpp95 Isolated on *Klebsiella pneumoniae*," Appl. Environ. Microbiol., (Apr. 2007), vol. 73, No. 8; pp. 2532-2540.

(Continued)

*Primary Examiner* — Robert M Kelly
(74) *Attorney, Agent, or Firm* — Carter, DeLuca & Farrell LLP

(57) ABSTRACT

The present disclosure relates generally to bacterial delivery vehicles for use in efficient transfer of a desired payload into a target bacterial cell. More specifically, the present disclosure relates to bacterial delivery vehicles with desired host ranges based on the presence of a chimeric receptor binding protein (RBP) composed of a fusion between the N-terminal region of a RBP derived from a lambda-like bacteriophage and the C-terminal region of a different RBP, and/or the presence of an engineered branched receptor binding multi-subunit polypeptides ("branched-RBP").

27 Claims, 14 Drawing Sheets

Specification includes a Sequence Listing.

(56) References Cited

PUBLICATIONS

Montag et al., "A component of the side tail fiber of *Escherichia coli* bacteriophage lambda can functionally replace the receptor-recognizing part of a long tail fiber protein of the unrelated bacteriophage T4," J. Bacteriol., (Aug. 1989), vol. 171, No. 8; pp. 4378-4384.

Vimr, et al., "Use of prokaryotic-derived probes to identify poly(sialic acid) in neonatal neuronal membranes," Proc. Natl. Acad. Sci., (Apr. 1984), vol. 81, No. 7; pp. 1971-1975.

Stummeyer, et al., "Crystal structure of the polysialic acid-degrading endosialidase of bacteriophage K1F," Nat. Struct. Mol. Biol., (Jan. 2005), vol. 12, No. 1; pp. 90-96.

Scholl et al., "*Escherichia coli* K1's Capsule Is a Barrier to Bacteriophage T7," Appl. Environ. Microbiol., (Aug. 2005), vol. 71, No. 8; pp. 4872-4874.

Jiang et al. "Multigene Editing in the *Escherichia coli* Genome via the CRISPR-Cas9 System," Appl. Environ. Microbiol., (Apr. 2015), vol. 81, No. 7; pp. 2506-2514.

Cronan, "Improved Plasmid-Based System for Fully Regulated Off-To-On Gene Expression in *Escherichia coli*: Application to Production of Toxic Proteins," Plasmid, (Jan. 2013), vol. 69, No. 1; pp. 81-89.

Thompson et al., "The K5 Lyase KflA Combines a Viral Tail Spike Structure with a Bacterial Polysaccharide Lyase Mechanism," J. Biol. Chem., (Jul. 2010), vol. 285, No. 31; pp. 23963-23969.

Potter et al., "HMMER web server: 2018 update," Nucleic Acids Res., (Jul. 2018), vol. 46, No. W1; pp. W200-W204.

Xu et al., "Chaperone-protein interactions that mediate assembly of the bacteriophage lambda tail to the correct length," J. Mol. Biol., (Mar. 2014), vol. 426, No. 5; pp. 1004-1018.

Schwarzer et al., "Proteolytic Release of the Intramolecular Chaperone Domain Confers Processivity to Endosialidase F," J. Biol. Chem., (Apr. 2009), vol. 284, No. 14; pp. 9465-9474.

Gilbert et al., "Current understanding of the human microbiome," Nat. Med., (Apr. 2018), vol. 24, No. 4; pp. 392-400.

Nkamga et al., "Archaea: Essential inhabitants of the human digestive microbiota," Hum. Microbiome J., (Mar. 2017), vol. 3; pp. 1-8.

Scholl et al., "The Genome of Bacteriophage K1F, a T7-Like Phage That Has Acquired the Ability To Replicate on K1 Strains of *Escherichia coli*," J. Bacteriol (Dec. 2005), vol. 187, No. 24; pp. 8499-8503.

Keen, "Tradeoffs in bacteriophage life histories," Bacteriophage, (Apr. 2014), vol. 4, No. 2; p. e28365.

Mirzaei et al., "Isolation of Phages for Phage Therapy: A Comparison of Spot Tests and Efficiency of Plating Analyses for Determination of Host Range and Efficacy," PLOS ONE, (Mar. 2015), vol. 10, No. 3, p. e0118557.

Goodridge et al., "Morphological, Host Range, and Genetic Characterization of Two Coliphages," Appl. Environ. Microbiol. (Sep. 2003), vol. 69, No. 9; pp. 5364-5371.

Ochman et al., "Standard reference strains of *Escherichia coli* from natural populations," J. Bacteriol, (Feb. 1984), vol. 157, No. 2; pp. 690-693.

McBurney et al., "Establishing What Constitutes a Healthy Human Gut Microbiome: State of the Science, Regulatory Considerations, and Future Directions," J. Nutr. (Nov. 2019), vol. 149, No. 11; pp. 1882-1895.

Nagpal et al., "Gut microbiome and aging: Physiological and mechanistic insights," Nutr. Healthy Aging (2018), vol. 4, No. 4; pp. 267-285.

Singh et al., "Influence of diet on the gut microbiome and implications for human health," J. Transl. Med. (Apr. 2017), vol. 15; pp. 1-17.

Tenaillon et al., "The population genetics of commensal *Escherichia coli*," Nat. Rev. Microbiol., (Mar. 2010), vol. 8, No. 3; pp. 207-217.

Nowrouzian et al., "*Escherichia coli* strains belonging to phylogenetic group B2 have superior capacity to persist in the intestinal microflora of infants," J. Infect. Dis., (Apr. 2005), vol. 191, No. 7; pp. 1078-1083.

Smati et al., "Quantitative analysis of commensal *Escherichia coli* populations reveals host-specific enterotypes at the intra-species level," MicrobiologyOpen (Aug. 2015), vol. 4, No. 4; pp. 604-615.

Hyman, "Phages for Phage Therapy: Isolation, Characterization, and Host Range Breadth," Pharmaceuticals, (Mar. 2019), vol. 12, No. 1; pp. 1-23.

Pantucek et al., "The polyvalent staphylococcal phage phi 812: its host-range mutants and related phages," Virology (Jul. 1998), vol. 246, No. 2; pp. 241-252.

Ross et al., "More Is Better: Selecting for Broad Host Range Bacteriophages," Front. Microbiol. (Sep. 2016), vol. 7; Article 1352; pp. 1-6.

Marusich et al., "Chaperones in bacteriophage T4 assembly," Biochem. Biokhimiia, (Apr. 1998), vol. 63, No. 4; pp. 399-406 (Abstract Only).

Golomidova et al., "Branched Lateral Tail Fiber Organization in T5-Like Bacteriophages DT57C and DT571/2 is Revealed by Genetic and Functional Analysis," Viruses, (Jan. 2016), vol. 8, No. 26; pp. 1-21.

Chen et al., "Crystal structure of ORF210 from *E. coli* O157:H1 phage CBA120 (TSP1), a putative tailspike protein," PloS One, (2014), vol. 9, No. 3; pp. e93156, 2014.

Kutter et al., "Characterization of a Vil-like phage specific to *Escherichia coli* O157:H7," Virology Journal (2011), vol. 8, No. 430; pp. 1-14 (PubMed—NCBI. [Online]. Available: https://www.ncbi.nlm.nih.gov/pubmed/21899740).

Arumugam et al., Enterotypes of the human gut microbiom, Nature (May 2011), vol. 473, No. 7346; pp. 174-180.

Kapitan et al., "Fungi as Part of the Microbiota and Interactions with Intestinal Bacteria," Current Topics in Microbiology and Immunology, (2019), vol. 422; pp. 265-301.

\* cited by examiner

BRANCHED RECEPTOR BINDING MULTI-SUBUNIT PROTEIN COMPLEXES FOR USE IN BACTERIAL DELIVERY VEHICLES

CROSS-REFERENCE TO RELATED APPLICATION

This application claims benefit and priority to U.S. Provisional Application Nos. 62/783,258, filed Dec. 21, 2018 and 62/802,777 filed Feb. 8, 2019, which are incorporated herein by reference in their entirety. This application is also a continuation-in-part of U.S. patent application Ser. No. 16/696,769, filed Nov. 26, 2019, which claims priority to 62/807,777 filed Feb. 8, 2019 which are incorporated herein by reference in their entireties.

TECHNICAL FIELD

The present disclosure relates generally to bacterial delivery vehicles for use in efficient transfer of a desired payload into a target bacterial cell.

BACKGROUND

Bacteriophages are parasites that infect and multiply in bacteria. In general, the infection process can be divided in several stages: (i) adsorption corresponding to recognition and binding to the bacterial cell; (ii) injection of the DNA genome into the bacterial cell cytoplasm; (iii) production of a set of viral proteins that can lead to insertion in the host target genome (lysogenic phages) or to the production of infective particles (lytic phages) and (iv) release of mature virions from the infected cell, usually by controlled lysis [1].

Being the first step necessary for a successful infection, recognition and binding to the target cell is an essential process in the bacteriophage life cycle. Bacteriophages can in some cases recognize several strains of the same species, having a "broad host range", but very commonly are able to recognize a specific antigen present only on some strains of the same species [2]. It is thus not surprising that this step of the infection process is central in the competition between bacteriophage and bacteria for successful infection.

As a general mechanism, a bacteriophage encodes two main sets of proteins that are involved in the recognition process. The first set is able to attach to the bacteriophage's primary receptor on the cell surface, an event that triggers DNA ejection into the cytoplasm and is usually viewed as an "irreversible" binding process [3]. Different bacteriophage genera differ in the organization of this set of proteins, and hence the naming can be different. In some Siphovirus, for example, they are called the "central tail fiber" or "tail tip", which binds irreversibly to the LamB receptor in *Escherichia coli*. In the siphoviridae lambda, the "central tail fiber" or "tail tip" is composed of the protein gpJ [4]. In some other Siphovirus, like T5, a protein located at the very tip of the tail mediates this process. In the case of T5, a protein called pb5 recognizes the FhuA receptor [5]. This type of protein can be found in many other bacteriophages. In Myoviruses, like T4, the irreversible binding to the primary receptor or to the cell surface in general is mediated by the "short tail fibers", which are also located at the end of the tail tube [5].

The second set of proteins in the bacteriophage (herein referred to as "receptor binding proteins") encodes recognition and binding activities to the so-called "secondary receptor" on the bacterium. This secondary receptor allows for transient binding of the phage particle on the cell surface in order to scan the surface and position the first set of proteins in contact with the primary receptor. Since this binding is reversible, it allows the phage to "walk" on the cell surface until a primary receptor is found and the infection process starts. These protein complexes are sometimes referred to as "L-shape fibers", such as in T5, "side tail fibers" such as in lambda, "long tail fibers" as in T4, or tailspikes such as in phage P22 [5]-[8]. For some phages, the presence of this second set of proteins is necessary for the infection process to occur, such as T4 [5]. In some other phages, like lambda, this second set of proteins is not strictly necessary for the infection process to happen, but it may allow for a more efficient binding to the target cell [7].

Since the adsorption process is strictly necessary for a successful infection to happen, bacteria can develop multiple ways to avoid being recognized by a bacteriophage. For example, they can mutate the primary or secondary receptor to which the bacteriophage binds; they can mask this receptor by attaching proteins to it (receptor masking); or they can grow physical barriers around them in the form of bacterial capsules, thus blocking any access to the cell surface [9]. Bacteria can produce many different types of extracellular polymeric capsules [10]. In turn, bacteriophages have evolved different strategies to bypass these defense mechanisms. For instance, mutating the tail tip proteins allows them to use a different receptor [11]. However, the presence of a polymeric capsule around the bacterium requires a different approach, as it blocks all contact to any receptors on the cell surface. In these cases, bacteriophages have evolved specific proteins that can enzymatically degrade this capsule to gain access to the cells. These depolymerase activities are encoded in protein complexes that are distinct to the primary receptor recognition machinery, in the form of side tail fibers, long tail fibers or tailspikes [12], [13], [14].

The concept of a bacteriophage's host range needs to be redefined when only the adsorption and injection processes are taken into account. Since all incompatibilities or defense mechanisms related to the phage replication cycle are left out of the picture, the "adsorption host range" of a given phage is usually larger than the "classical host range" in which the infectious cycle leads to newly produced mature virions. The concept of host range becomes even more different to the classical definition when packaged phagemids based on a given bacteriophage capsid is used. Packaged phagemids do not contain the information necessary to replicate the viral particles, because they do not package their cognate viral genome. Thus, the host range of a packaged phagemid tends to be larger than that of the parental bacteriophage it derives from. Therefore, for development of novel bacterial delivery vehicles, designed for the efficient delivery of exogenous DNA payload into target strains, it is of utmost importance to be able to engineer delivery vehicles with desired host ranges as well as the ability to bypass bacterial mechanisms that can lead to unsuccessful binding of the packaged phagemid to the bacterial cell surface.

SUMMARY

As a general mechanism, a bacteriophage encodes sets of proteins that are involved in the bacterial cell recognition process. Described herein are novel approaches to engineering synthetic bacterial delivery vehicles with desired target host ranges.

In some aspects, synthetic bacterial delivery vehicles are provided that are characterized by a chimeric receptor binding protein (RBP), wherein the chimeric RBP comprises a fusion between an N-terminal domain of a RBP from a lambda-like bacteriophage, or lambda bacteriophage, and a C-terminal domain of a different bacteriophage RBP. Such bacteriophage RBPs, from which the chimeric RBP are derived, include, for example, and depending on phages families, "L-shape fibers", "side tail fibers (stfs)", "long tail fibers" or "tailspikes." As disclosed herein, it has been demonstrated that a significant portion of a lambda-like bacteriophage receptor binding protein (RBP), such as a stf protein, can be exchanged with a portion of a different RBP. Moreover, specific fusion positions in the RBPs have been identified which allow one to obtain functional chimeric RBPs.

In additional aspects, the disclosure relates to bacterial delivery vehicles with desired host ranges based on the presence of an engineered branched receptor binding multi-subunit protein complex ("branched-RBP"). The branched-RBP comprises two or more associated receptor binding proteins derived from bacteriophages, wherein said RBPs contain "interaction domains" (IDs) that mediate association of the different subunits. The association of one subunit to another can be non-covalent or covalent. The two or more associated RBPs include, but are not limited to, the chimeric receptor binding proteins (RBPs) described herein that comprise a fusion between the N-terminal domain of a RBP derived from a lambda-like, or lambda bacteriophage and the C-terminal domain of a different RBP.

The chimeric receptor binding protein (RBP) is one wherein the chimeric RBP comprises a fusion between an N-terminal domain of a RBP derived from a lambda-like bacteriophage, or lambda bacteriophage, and a C-terminal domain of a different RBP wherein said N-terminal domain of the RBP is fused to said C-terminal domain of a different RBP within one of the amino acids regions selected from positions 1-150, 320-460, or 495-560 of the N-terminal RBP with reference to the lambda stf sequence (SEQ ID NO: 1) or a similar region of a RBP having homology with one or more of three amino acid regions ranging from positions 1-150, 320-460, and 495-560 of the RBP with reference to the lambda stf sequence. In one specific aspect of the invention, the different RBP domain of the chimeric receptor binding protein (RBP) is derived from any bacteriophage or from any bacteriocin. In one specific aspect, the RBP from the lambda-like bacteriophage, or the lambda bacteriophage, or the different RBP contains homology in one or more of three amino acid regions ranging from positions 1-150, 320-460, or 495-560 of the N-terminal RBP with reference to the lambda bacteriophage stf sequence (SEQ ID NO: 1). In certain aspects, the homology between the lambda-like bacteriophage, the lambda bacteriophage, or the different RBP and the one or more of three amino acids regions is around 35% identity for 45 amino acids or more, around 50% identify for 30 amino acids or more, and around 90% identity for 18 amino acids or more with reference to the lambda bacteriophage stf sequence (SEQ ID NO:1). Determination of homology can be performed using alignment tools such as the Smith-Waterman algorithm (Smith et al., 1981, J. Mol. Biol 147:195-197) or EMBOSS Matcher (Rice, Longden, Bleasby 2000 EMBOSS Trends in Genetics 16: 276-277).

In one aspect of the invention, the chimeric RBP comprises the N-terminal domain of a RBP fused to the C-terminal domain of a different RBP within one of the amino acid regions selected from positions 80-150, 320-460, or 495-560 of the N-terminal RBP with reference to the lambda bacteriophage stf sequence (SEQ ID NO:1). In another embodiment of the invention, the chimeric RBP comprises an N-terminal domain and a C-terminal domain fused within one of the amino acids regions selected from positions 1-150, 320-460 or 495-560 at an insertion site having at least 80%, preferably at least 85%, at least 90%, at least 95%, at least 98% or at least 99%, identity with an insertion site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203). In a more specific embodiment of the invention, the chimeric RBP comprises an N-terminal domain and a C-terminal domain fused within one of the amino acids regions selected from positions 1-150, 320-460 or 495-560 at an insertion site having at least 80%, preferably at least 85%, at least 90%, at least 95%, at least 98% or at least 99%, identity with an insertion site selected from the group consisting of amino acids SAGDAS (SEQ ID NO:190), ADAKKS (SEQ ID NO:191), MDETNR (SEQ ID NO:192), SASAAA (SEQ ID NO:193) and GAGENS (SEQ ID NO:194).

In another aspect, the chimeric RBP comprises the N-terminal domain of a RBP fused to the C-terminal domain of different RBP wherein the different RBP is a protein or group a different proteins that confers an altered host range. In one embodiment, the different RBP is a T4-like or T4 long tail fiber composed of a proximal tail fiber and a distal tail fiber (DTF), and the C-terminal domain of a T4-like or T4 RBP is the distal tail fiber (DTF). In another embodiment, the N-terminal domain of a RBP is fused to the T4-like or T4 distal tail fiber at an insertion site within the T4-like or T4 DTF having at least 80%, preferably at least 85%, at least 90%, at least 95%, at least 98% or at least 99%, identity with an insertion site selected from the group consisting of amino acids ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203). In a specific embodiment, the N-terminal domain of a RBP is fused to the T4-like or T4 distal tail fiber within a region from amino acid 1 to 90, with a preferred region from amino acid 40 to 50 of the DTF.

In specific embodiments, the disclosure provides specific chimeric RBPs. SEQ ID NOS 2-61, 135-165, 215-242, 271, 273, 282 and 283 disclose the amino acid sequences of such chimeric RBPs as well as, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 135 to 144, 147, 150, 151, 154, 157, 160, 163, 215, 216, 219, 221, 223, 225, 227, 229, 232, 325, 237, 239, 241, 282 or 283. In a more specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56 or 59.

In another aspect, the present disclosure provides nucleotide sequences encoding for the chimeric RBPs disclosed herein. In a specific embodiment, nucleic acids encoding such chimeric RBPs, as well as their corresponding AP proteins, are depicted in SEQ ID NOS 62-120, 166-189, 206-212, 243-270, 272, 274 and 284. In a specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 166, 167, 168, 171, 174, 175, 178, 181, 184, 187, 206, 207, 208, 209, 210, 211, 212, 243, 244, 247, 249, 251, 253, 255, 257, 260, 263, 265, 267, 269 or 284. In a more specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116 or 119.

In one specific non-limiting aspect of the invention, it has been demonstrated that engineering the chimeric RBP to encode enzymatic activity such as depolymerase activity can dramatically increase the delivery efficiency of the provided bacterial delivery vehicles comprising the chimeric RBP disclosed herein. In an embodiment of the invention, the different RBP domain of the chimeric RBP comprises enzymatic activity such as depolymerase activity against an encapsulated bacterial strain. In a specific embodiment, the depolymerase is an endosialidase such as, for example, a K1F or K5 endosialidase.

In another aspect, the present disclosure provides for engineered branched-RBPs, as well as bacterial delivery vehicles, with desired host ranges and/or specific biological functions, based on the presence of an engineered branched receptor binding multi-subunit protein complex ("branched-RBP"). The engineered branched-RBP comprises two or more associated receptor binding proteins, derived from bacteriophages that associated with one another based on the presence of interaction domains (IDs). Each of the protein complex subunits contain IDs that function as "anchors" for association of one subunit RBP with another. The association of one subunit with another can be non-covalent or covalent. The engineered branched RBP may comprise non-covalent association of the different subunits; in some instance, the engineered branched RBP may comprise covalent association of the different subunits; and in further instances, the engineered branched RBP may comprise both covalent and non-covalent associations of the different subunits. In instances where the association is non-covalent, the protein subunits are assembled into the engineered branched-RBP as separate protein subunits each having their own ID. In a non-limiting example, where the interaction is covalent, the engineered branched-RBP may exist as a single fusion protein comprising different protein domains of interest fused to two or more ID domains. In specific embodiments, the branched-RBP may comprise multiple RBP subunits, including, for example, two, three, four, etc. subunits. Each of the RBP subunits may bring different biological functions to the overall branched-RBP. Such functions include, but are not limited to, host recognition and enzymatic activity. Such enzymatic activity includes depolymerase activity.

Disclosed herein are amino acid sequences that are able to function as interaction domains (IDs). Such IDs, for purposes of the present invention, are those amino acid sequences that provide for association of one subunit to another thereby providing for assembly of the engineered branched-RBPs. The IDs may be naturally occurring bacteriophage IDs, IDs derived from non-bacteriophage polypeptides, or recombinantly derived IDs. The two or more of the associated receptor binding proteins of the engineered branched-RBP may be any bacteriophage RBP, or a functional domain of a bacteriophage RBP, e.g. a domain that provides desired host range or biological activity, wherein said RBP, or the domain of an RBP, are fused to an ID. The associated receptor binding proteins may include, but are not limited to, chimeric receptor binding proteins (RBPs) described herein that comprise of a fusion between the N-terminal domain of a RBP derived from a lambda-like, or lambda bacteriophage and the C-terminal domain of a different RBP wherein said chimeric RBP also comprises an ID.

In an embodiment of the invention, nucleic acid molecules encoding the chimeric RBPs disclosed herein, as well as the two or more subunit RBPs of the engineered branched-RBP, are provided. Such nucleic acids may be included in vectors such as bacteriophages, plasmids, phagemids, viruses, and other vehicles which enable transfer and expression of the chimeric RBP encoding nucleic acids. In instances where the subunits of a branched-RBP are to be expressed, it may be advantageous to express the subunits from a polycistronic expression unit containing multiple ribosomal binding sites (RBSs). The use of such an expression unit can be used to regulate the expression of each of the RBP subunits so that equal quantities of expression of each subunit are achieved.

Bacterial delivery vehicles are provided which enable transfer of a nucleic acid payload, encoding a protein or nucleic acid of interest, into a desired target bacterial host cell. Such bacterial delivery vehicles are characterized by having a chimeric RBP comprising a fusion between the N-terminal domain of a RBP from a lambda-like bacteriophage, or lambda bacteriophage, and the C-terminal domain of a different RBP. In an embodiment of the invention, the bacterial delivery vehicles contain a chimeric RBP comprising a fusion between an N-terminal domain of a RBP derived from a lambda-like bacteriophage, or lambda bacteriophage, and a C-terminal domain of a different RBP wherein said N-terminal domain of the chimeric RBP is fused to said C-terminal domain of a different RBP within one of the amino acids regions selected from positions 1-150, 320-460, or 495-560 of the N-terminal domain with reference to the lambda stf sequence (SEQ ID NO: 1). In one aspect, the RBP from the lambda-like bacteriophage, the lambda bacteriophage, and the different RBP contain homology in one or more of three amino acids regions ranging from positions 1-150, 320-460, and 495-560 of the RBP with reference to the lambda bacteriophage stf sequence (SEQ ID NO: 1). In certain aspects, the homology is around 35% identity for 45 amino acids or more, around 50% identify for 30 amino acids or more, or around 90% identity for 18 amino acids or more within the one or more of three amino acids regions ranging from positions 1-150, 320-460, and 495-560 of the RBP with reference to the lambda bacteriophage stf sequence (SEQ ID NO:1). In one specific aspect of the invention, the different RBP domain of the chimeric receptor binding protein (RBP) is derived from a bacteriophage or a bacteriocin. In one aspect of the invention, the chimeric RBP comprises an N-terminal domain of a RBP fused to a C-terminal domain of a RBP within one of the amino acids regions selected from positions 80-150, 320-460, or 495-560 of the N-terminal RBP domain with reference to the lambda stf sequence (SEQ ID NO:1). In another embodiment of the invention, the chimeric RBP comprises an N-terminal domain of a RBP and a C-terminal domain of a RBP fused within a site of the N-terminal RBP domain having at least 80%, preferably at least 85%, at least 90%, at least 95%, at least 98% or at least 99%, identity with a site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203), preferably with a site selected from the group consisting of amino acids SAGDAS (SEQ ID NO:190), ADAKKS (SEQ ID NO:191), MDETNR (SEQ ID NO:192), SASAAA (SEQ ID NO:193) and GAGENS (SEQ ID NO:194).

In specific embodiments, the disclosure provides a bacterial delivery vehicle comprising a chimeric RBP. SEQ ID NOS 2-61, 135-165, 215-242, 271, 273, 282 and 283 disclose the amino acid sequences of such chimeric RBPs and in addition, in some instances, their corresponding natural chaperone proteins (designated "AP"). Such AP proteins assist in the folding of the chimeric PBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 135 to 144, 147, 150, 151, 154, 157, 160, 163, 215, 216, 219, 221, 223, 225, 227, 229, 232, 325, 237, 239, 241, 282 or 283. In a more specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56 or 59.

In one aspect, the present disclosure also provides nucleotide sequences encoding for the chimeric RBPs disclosed herein. In a specific embodiment, nucleic acids encoding such chimeric RBPs, as well as corresponding AP proteins, are depicted in SEQ ID NOS 62-120, 166-189, 206-212, 243-270, 272, 274 and 284. In a specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 166, 167, 168, 171, 174, 175, 178, 181, 184, 187, 206, 207, 208, 209, 210, 211, 212, 243, 244, 247, 249, 251, 253, 255, 257, 260, 263, 265, 267, 269 or 284. In a more specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, or 119.

In other specific embodiments and to increase the delivery efficiency of the bacterial delivery vehicles disclosed herein the different RBP domain of the chimeric RBP comprises a domain having depolymerase activity against an encapsulated bacterial strain. In a specific embodiment, the depolymerase is an endosialidase, such as for example, a K1F or K5 endosialidase.

In another aspect of the invention, bacterial delivery vehicles are provided which enable transfer of a nucleic acid payload, encoding a protein or nucleic acid of interest, into a desired target bacterial host cell wherein said bacterial delivery vehicles are characterized by having a branched-RBP as disclosed herein.

The bacterial delivery vehicles provided herein enable transfer of a nucleic acid payload, encoding a protein or nucleic acid of interest, into a desired target bacterial host cell. In certain embodiments of the invention, the nucleic acid of interest is selected from the group consisting of a Cas nuclease gene, a Cas9 nuclease gene, a guide RNA, a CRISPR locus, a toxin gene, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor, and a gene expressing a virulence protein or a virulence factor, or any of their combination. In an embodiment of the invention, the nucleic acid payload encodes a therapeutic protein. In another embodiment, the nucleic acid payload encodes an anti-sense nucleic acid molecule.

In one aspect, the bacterial delivery vehicle enables the transfer of a nucleic acid payload that encodes a nuclease that targets cleavage of a host bacterial cell genome or a host bacterial cell plasmid. In some aspects, the cleavage occurs in an antibiotic resistant gene. In another embodiment of the invention, the nuclease mediated cleavage of the host bacterial cell genome is designed to stimulate a homologous recombination event for insertion of a nucleic acid of interest into the genome of the bacterial cell.

The present invention also provides pharmaceutical or veterinary compositions comprising one or more of the bacterial delivery vehicles disclosed herein and a pharmaceutically-acceptable carrier. Also provided is a method for treating a disease or disorder caused by bacteria, preferably a bacterial infection, comprising administering to a subject having a disease or disorder caused by bacteria, preferably a bacterial infection, in need of treatment the provided pharmaceutical or veterinary composition. The present invention also relates to a pharmaceutical or veterinary composition as disclosed herein for use in the treatment of a disease or disorder caused by bacteria, preferably a bacterial infection. It further relates to the use of a pharmaceutical or veterinary composition as disclosed herein for the manufacture of a medicament for treating a disease or disorder caused by bacteria, preferably a bacterial infection. A method for reducing the amount of virulent and/or antibiotic resistant bacteria in a bacterial population is provided comprising contacting the bacterial population with the bacterial delivery vehicles disclosed herein. The method may be an in vivo or in vitro method. The present invention also relates to a pharmaceutical or veterinary composition as disclosed herein for use in reducing the amount of virulent and/or antibiotic resistant bacteria in a bacterial population, in particular in a subject having a bacterial infection. It further relates to the use of a pharmaceutical or veterinary composition as disclosed herein for the manufacture of a medicament for reducing the amount of virulent and/or antibiotic resistant bacteria in a bacterial population, in particular in a subject having a bacterial infection.

BRIEF DESCRIPTION OF FIGURES

In order to better understand the subject matter that is disclosed herein and to exemplify how it may be carried out in practice, embodiments will now be described, by way of non-limiting example, with reference to the accompanying drawings. With specific reference to the drawings, it is stressed that the particulars shown are by way of example and for purposes of illustrative discussion of embodiments of the invention.

Figure 3:
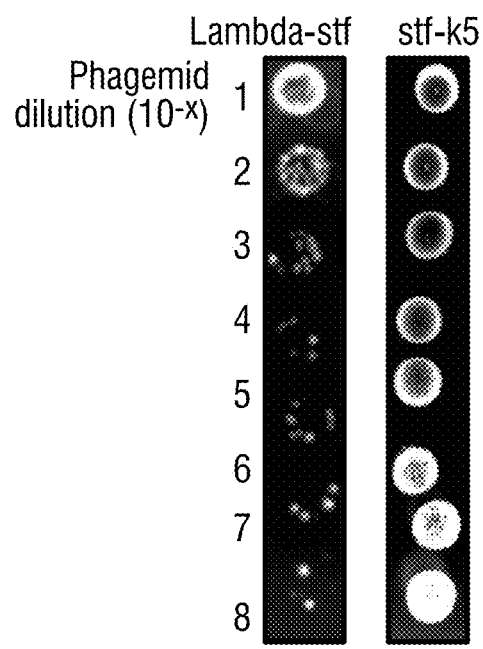

FIG. 3 depicts wild-type lambda and lambda-stf-K5 chimeric delivery vehicles on a K5+ strain. Lambda packaged phagemids were sequentially diluted 10× in LB plus 5 mM $CaCl_2$) and 10 μL added in each well. ECOR55 grown to an $OD_{600}$ of around 0.5 were then added to each phagemid dilution, incubated for 30 min at 37° C. and 10 μL plated on LB supplemented with chloramphenicol. Left panel, wild type lambda packaged phagemids; right panel, stf-K15 lambda packaged phagemids.

Figure 4:
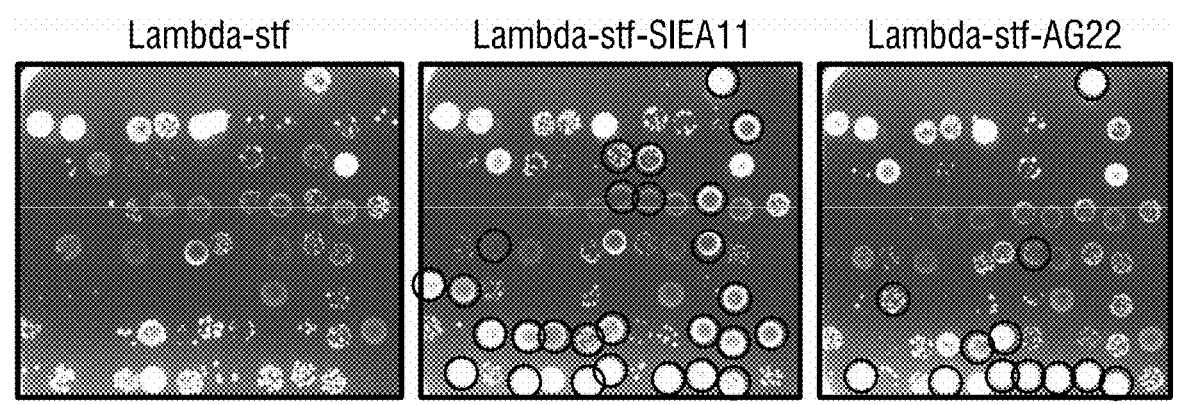

FIG. 4 depicts wild-type lambda, lambda-stf-AG22 and lambda-stf-SIEA11 chimeric delivery vehicles on a variety of encapsulated strains (O and K capsules). Lambda phagemids were diluted 1:5 in LB plus 5 mM $CaCl_2$) and 10 μL added in each well. 90 μL of cells grown to an $OD_{600}$ of around 0.5 were then added to each phagemid-containing well, incubated for 30 min at 37° C. and 10 μL spotted on LB-agar supplemented with chloramphenicol. Left panel, wild type lambda phagemids; middle panel, lambda stf-SIEA11 variant; right panel, lambda-stf-AG22 variant. Circles show strains with modified delivery as compared to lambda wild-type.

Figure 5A:
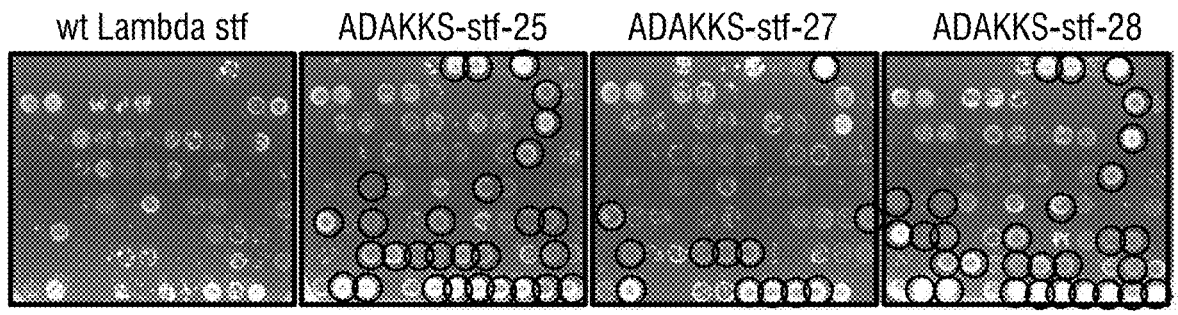
Figure 5B:
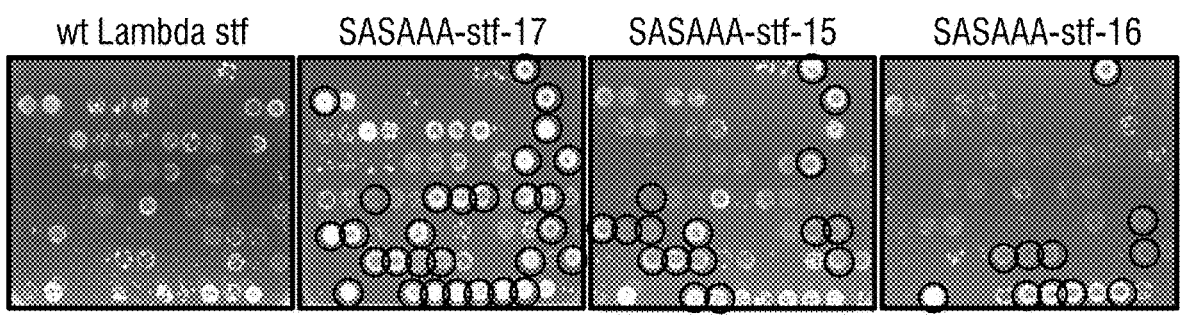
Figure 5C:
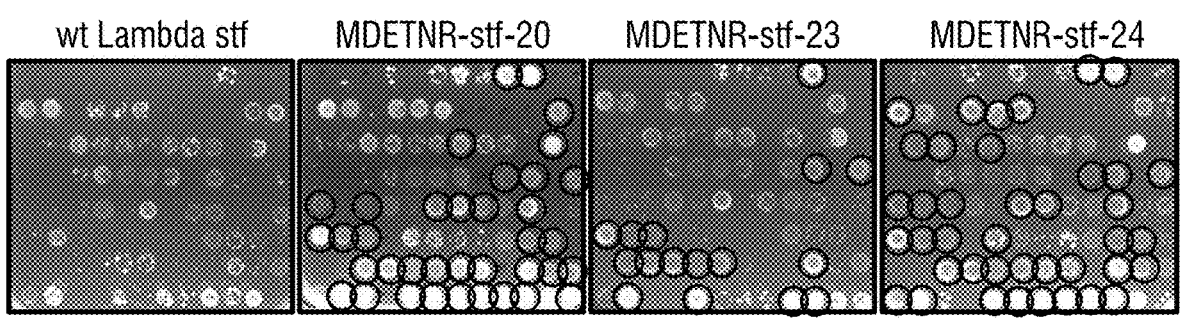

FIG. 5A-C demonstrates delivery of wild-type lambda and stf chimeras with different insertion sites on a variety of encapsulated strains (O and K capsules). Lambda packaged phagemids were diluted 1:5 in LB plus 5 mM $CaCl_2$) and 10 μL added in each well. 90 μL of cells grown to an $OD_{600}$ of around 0.5 were then added to each phagemid-containing well, incubated for 30 min at 37° C. and 10 μL spotted on LB-agar supplemented with chloramphenicol. FIG. 5A. Left panel, wild type lambda packaged phagemids; rest of panels, three different ADAKKS (SEQ ID NO:191)-stf variants. FIG. 5B Left panel, wild type lambda packaged phagemids; rest of panels, three different SASAAA (SEQ ID NO: 193)-stf variants. FIG. 5C Left panel, wild type lambda packaged phagemids; rest of panels, three different MDE-TNR (SEQ ID NO:192)-stf variants. For all panels, red circles show strains with improved delivery efficiency as compared to lambda wild-type.

Figure 6:
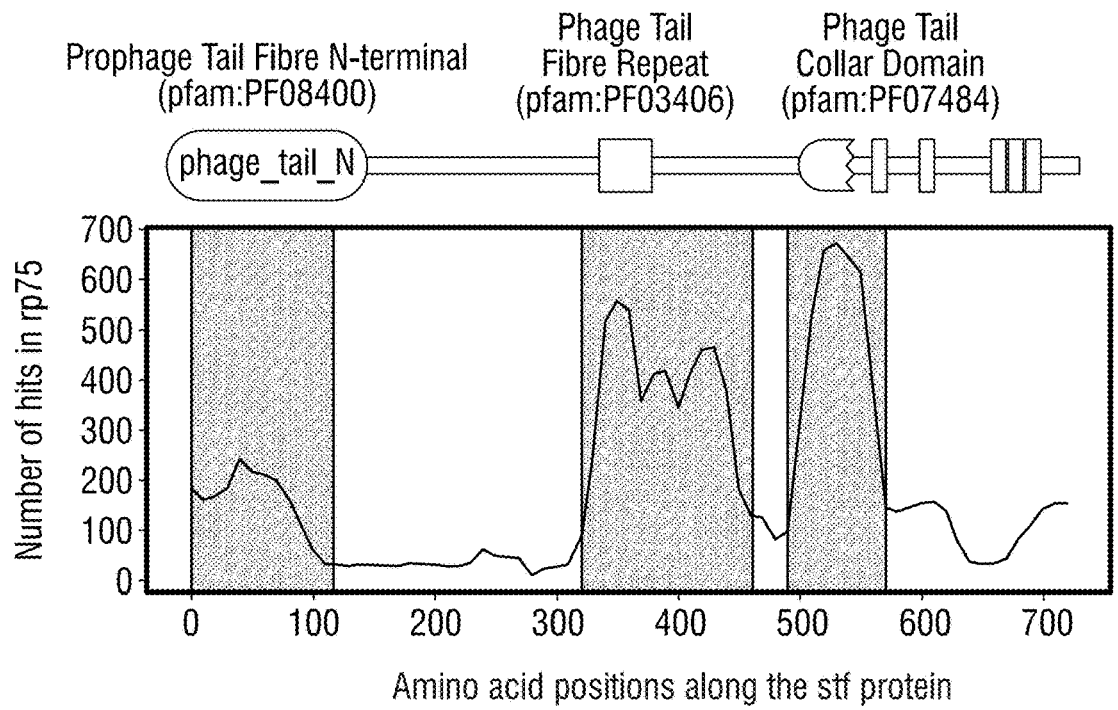

FIG. 6 depicts a phmmer search that was performed with a 50aa sliding window (step 10) on the representative proteome database (rp75). The number of significant hits (E-value<0.01) is reported.

Figure 7A:
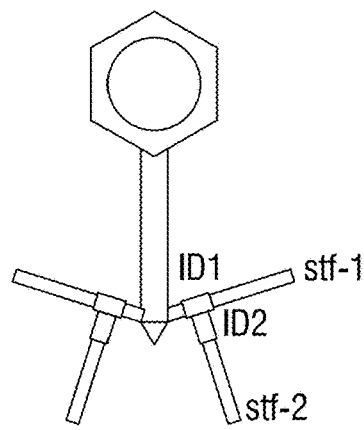
Figure 7B:
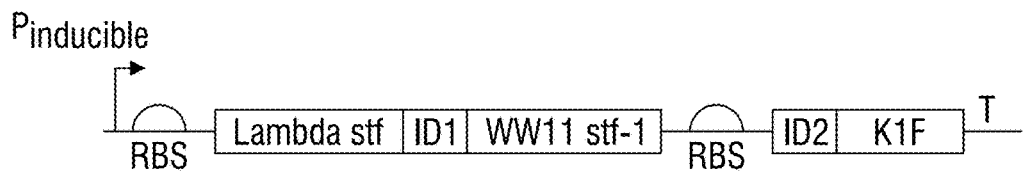

FIG. 7A-B depicts branched stf architectures with 2 subunits. FIG. 7A is a schematic view of a delivery vehicle with a 2 subunits branched stf architecture. ID: "Interaction Domain". FIG. 7B is a schematic view of the genetic architecture of an engineered lambda stf construct.

Figure 8:
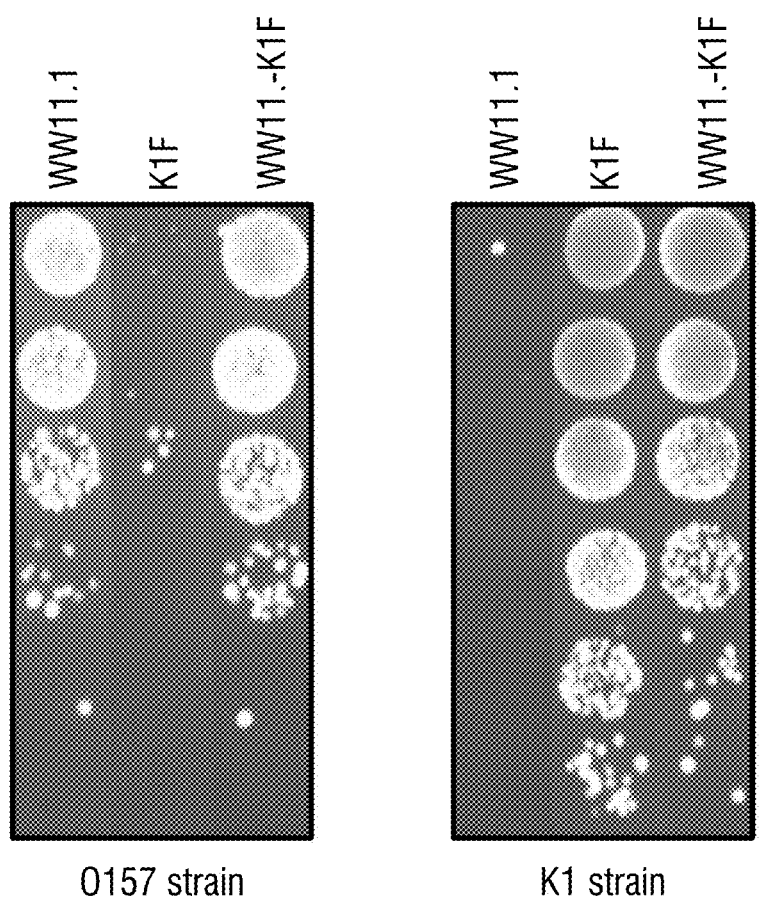

FIG. 8 demonstrates delivery of branched lambda stf packaged phagemids. Lambda packaged lambda-stf-WW11.1 stf, lambda-stf-K1F or the branched construct shown in FIG. 7 (WW11.1-K1F) were produced and titrated against O57 and K1 strains.

Figure 9A:
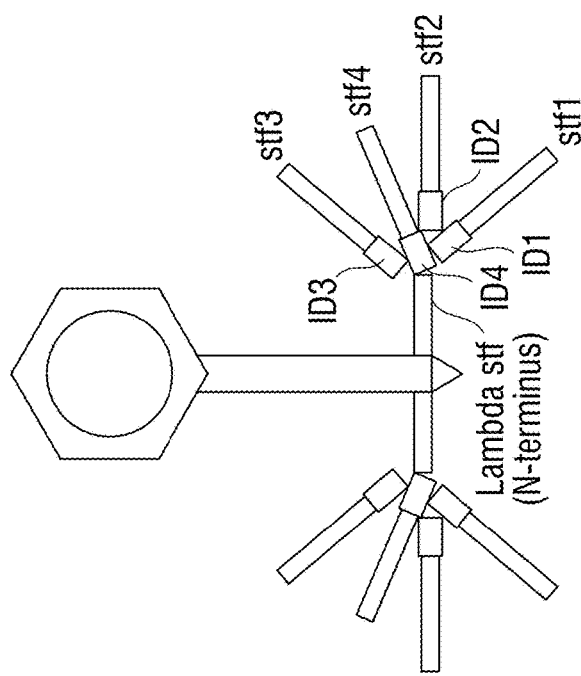
Figure 9B:
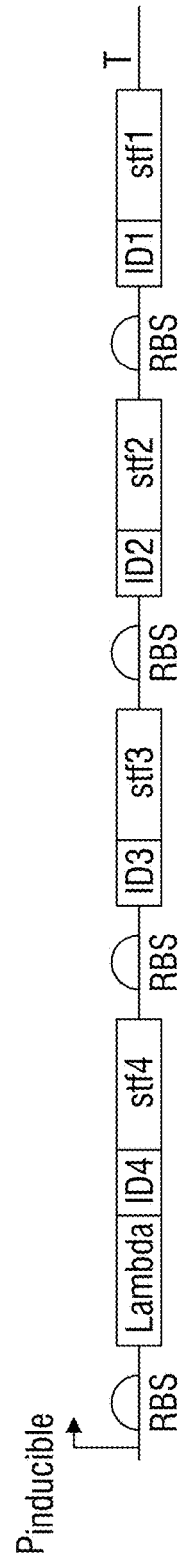

FIG. 9A-B depicts branched stf architectures with 4 subunits. FIG. 9A is a schematic view of a delivery vehicle with a 4 subunits branched stf architecture. Actual interactions among different ID may be different in the biological assembly from the graph depicted here. FIG. 9B depicts a genetic circuit encoding the 4 subunits branched stf under the control of an inducible promoter.

Figure 10:
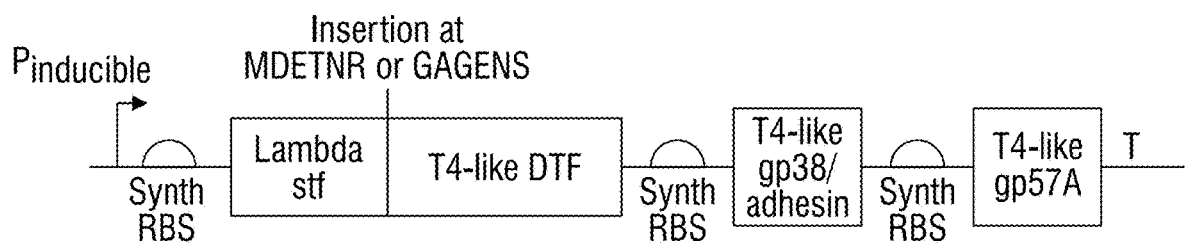

FIG. 10. depicts architecture of the engineered lambda stf-T4-like DTF chimera. The semicircles denote RBS sites; the T sign, a transcriptional terminator; the arrow, a promoter.

Figure 11:
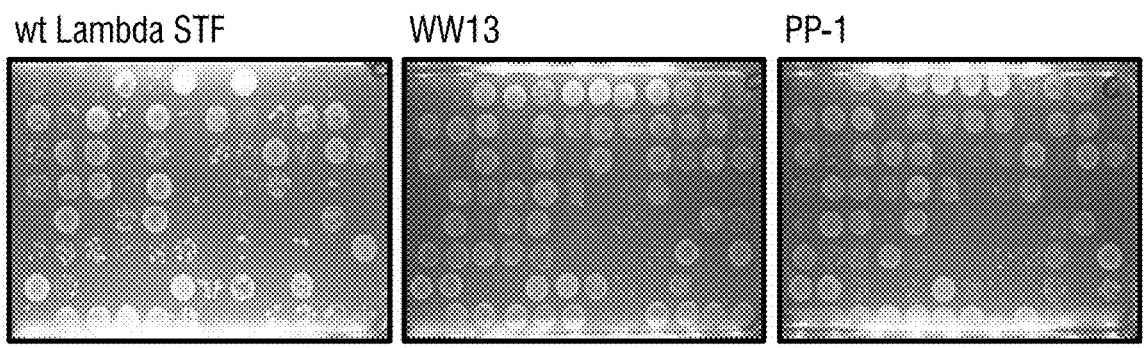

FIG. 11. shows screening of phagemid particles with chimeric lambda stf-T4-like DTFs. A collection of 96 different wild type *E. coli* strains, encompassing different serotypes, was transduced with lambda-based phagemids and plated on Cm LB agar. Left panel, wild-type lambda stf; middle panel, chimeric lambda-stf-WW13; right panel, chimeric lambda-stf-PP-1.

Figure 12:
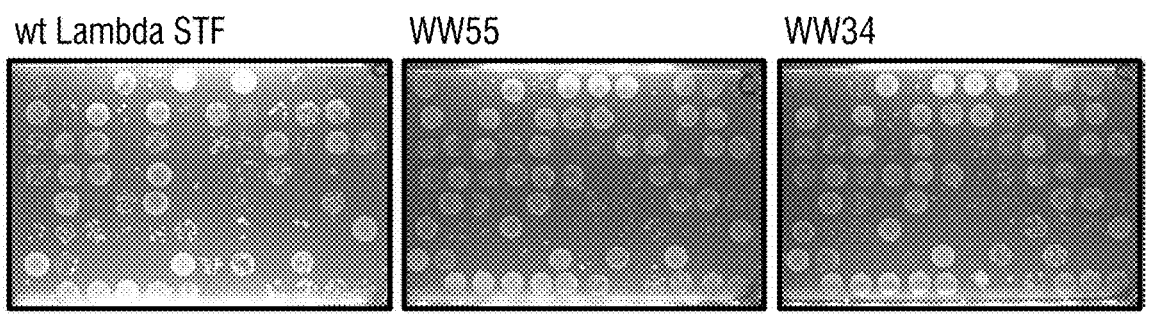

FIG. 12. demonstrates screening of phagemid particles with chimeric lambda stf-T4-like DTFs. A collection of 96 different wild type *E. coli* strains, encompassing different serotypes, was transduced with lambda-based phagemids and plated on Cm LB agar. Left panel, wild-type lambda stf; middle panel, chimeric lambda-stf-WW55; right panel, chimeric lambda-stf-WW34.

Figure 13:
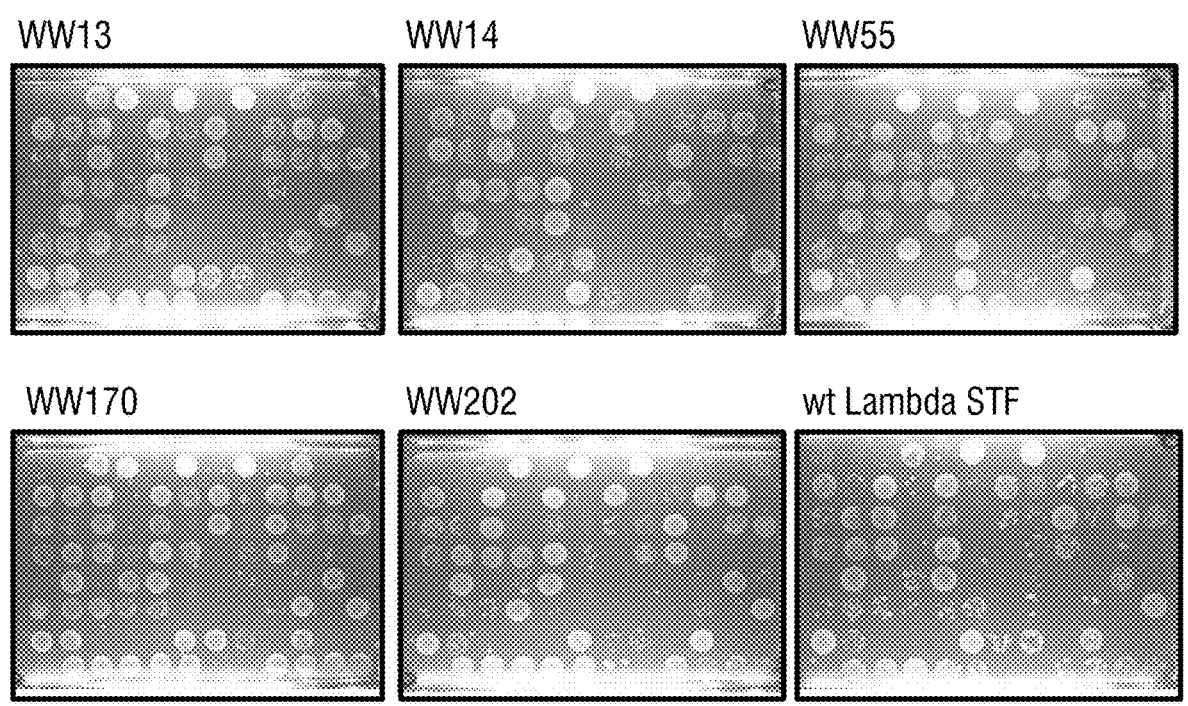

FIG. 13. depicts screening of phagemid particles with chimeric lambda stf-T4-like DTFs. All points shown refer to the universal insertion site of the DTF, located within amino acid range from position 1 to 90 with reference to WW13 amino acid sequence. A collection of 96 different wild type *E. coli* strains, encompassing different serotypes, was transduced with lambda-based phagemids and plated on Cm LB agar (names on top).

Figure 14:
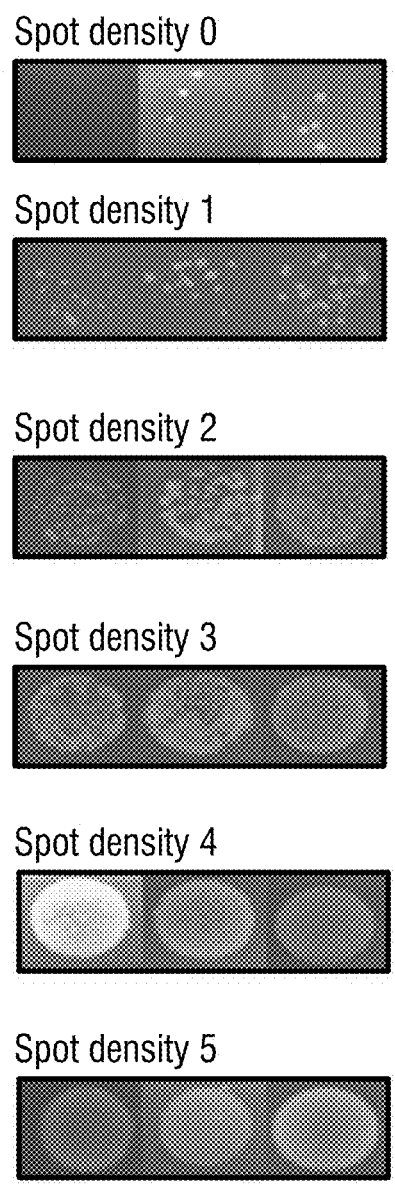
Figures 1, 15:
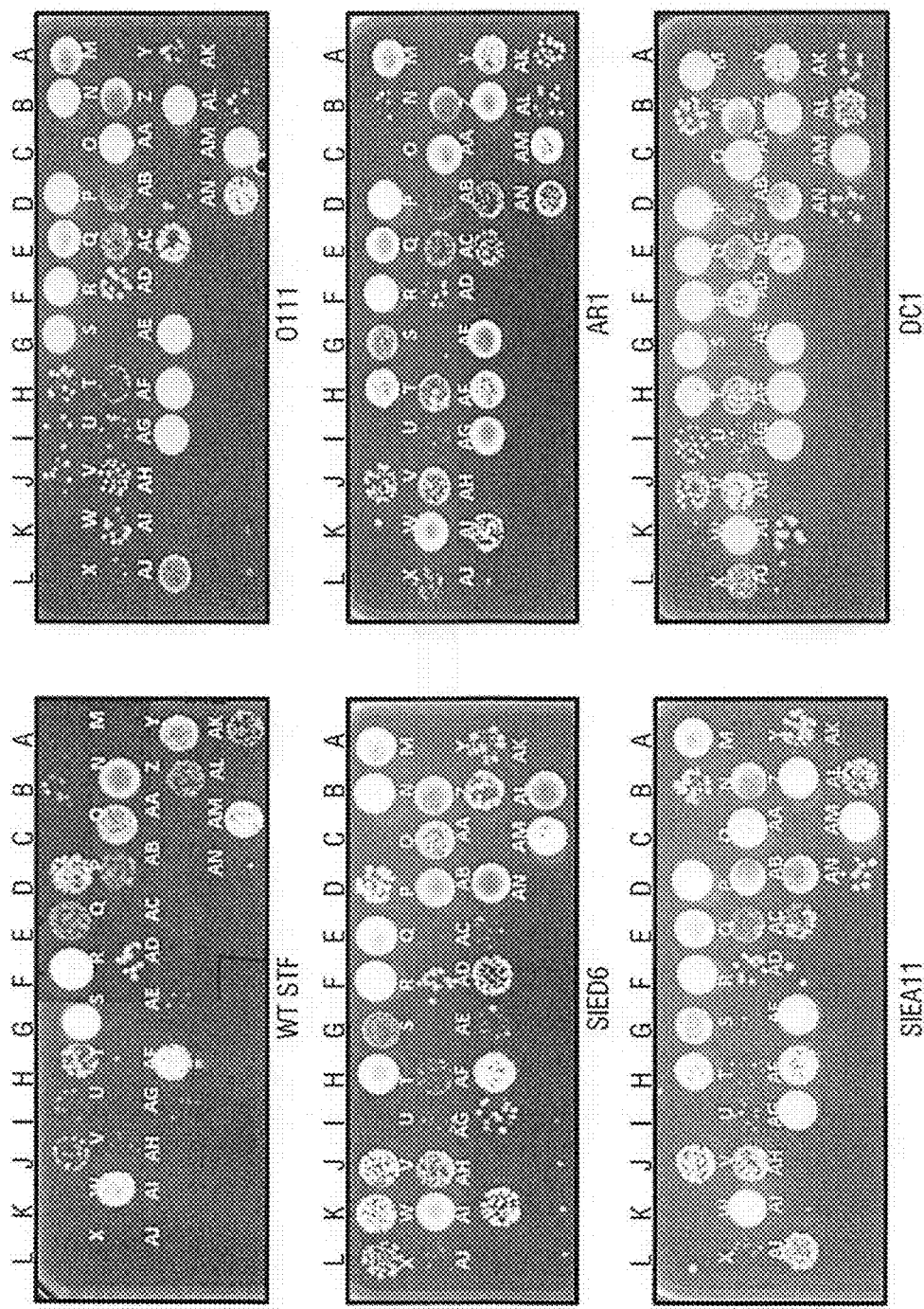
Figures 2, 15:
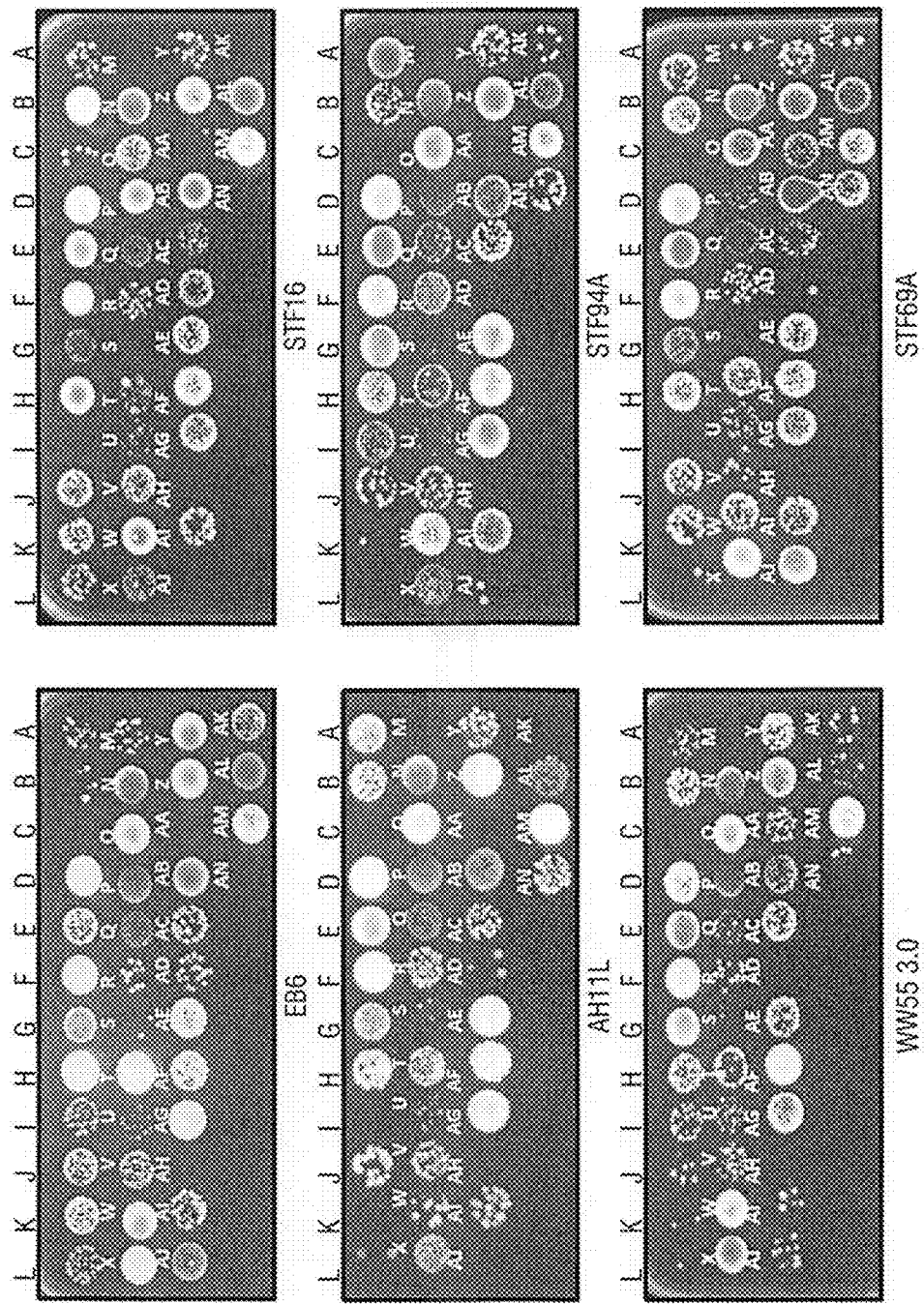
Figures 3, 15:
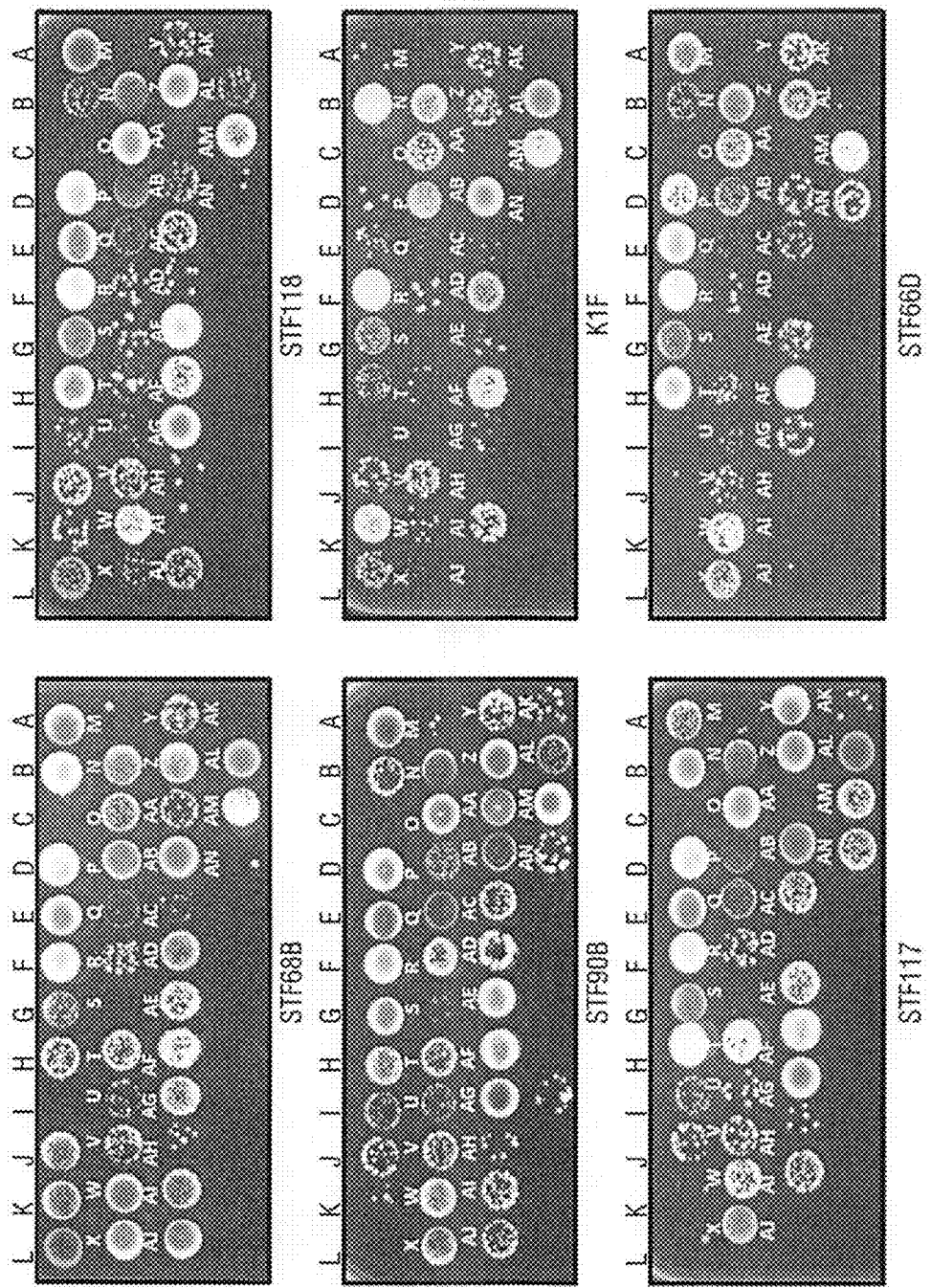

FIG. 14. depicts dot scoring system to quantify delivery efficiency. Density 0, 5 or fewer colonies; density 1, more than 5 colonies but not enough to define a clear circular drop; density 2, several colonies, but the background is clearly visible and some colonies are still separated; density 3, many colonies, the background is still visible but the colonies are hardly discernible as separate; density 4, spot almost completely dense, the background can only be seen faintly in some parts of the drop; density 5, spot looks completely dense, background cannot be seen.

FIG. 15-1, FIG. 15-2, FIG. 15-3 depicts raw dot titrations of delivery particles with chimeric stf in 40 human strains of the ECOR collection. Below each panel, the name of the chimeric stf. Above each dot, the 1-2 letter code used to identify strains.

Figure 1:
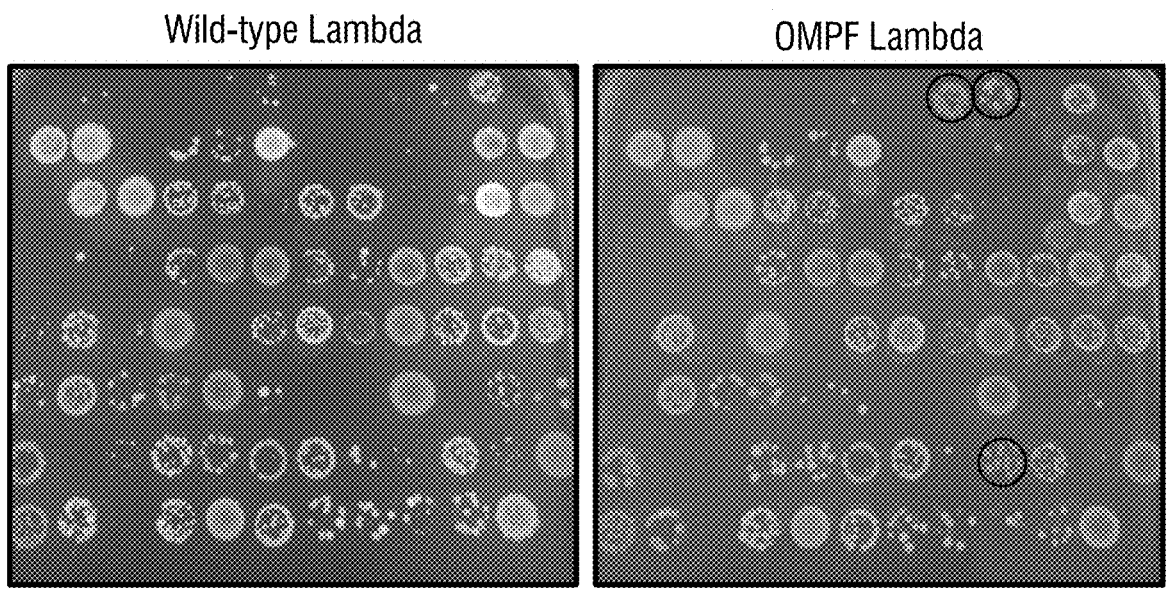
FIG. 1 demonstrates delivery in wild-type *E. coli* strains with lambda and OMPF-lambda packaged phagemids. Lambda packaged phagemids were diluted 1:5 in LB plus 5 mM $CaCl_2$) and 10 µL added in each well. 90 µL of cells grown to an $OD_{600}$ of around 0.5 were then added to each phagemid-containing well, incubated for 30 min at 37° C. and 10 µL spotted on LB-agar supplemented with chloramphenicol. Left panel, wild type lambda packaged phagemids; right panel, OMPF-lambda variant. Circles show strains with modified delivery as compared to lambda wild-type.
Figure 2:
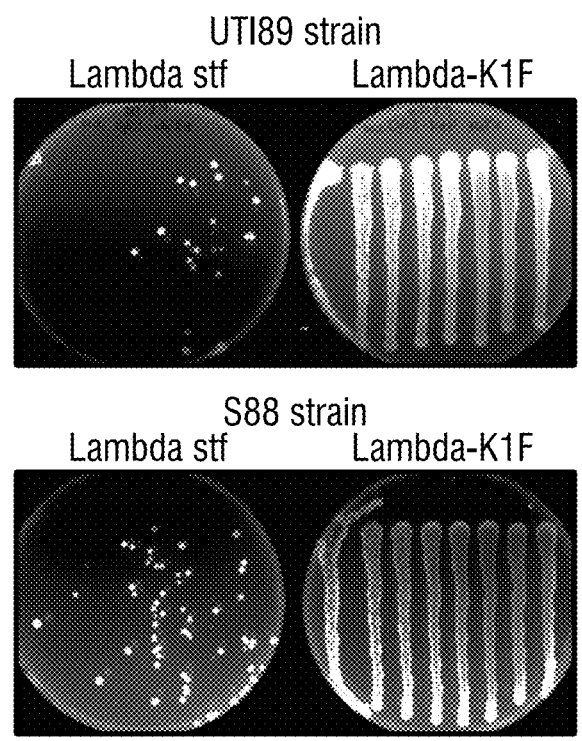
FIG. 2 depicts wild-type lambda and lambda-stf-K1F chimeric delivery vehicles on K1+ strains. Lambda packaged phagemids were sequentially diluted 10× in LB plus 5 mM $CaCl_2$) and 10 μL added in each well. Cells grown to an $OD_{600}$ of around 0.5 were then added to each phagemid dilution, incubated for 30 min at 37° C. and 10 μL plated on LB supplemented with chloramphenicol. Top panel, strain UTI89; bottom panel, strain S88. Left plates, wild type lambda packaged phagemids; right plates, stf-K1F lambda packaged phagemids.
Figures 1, 16:
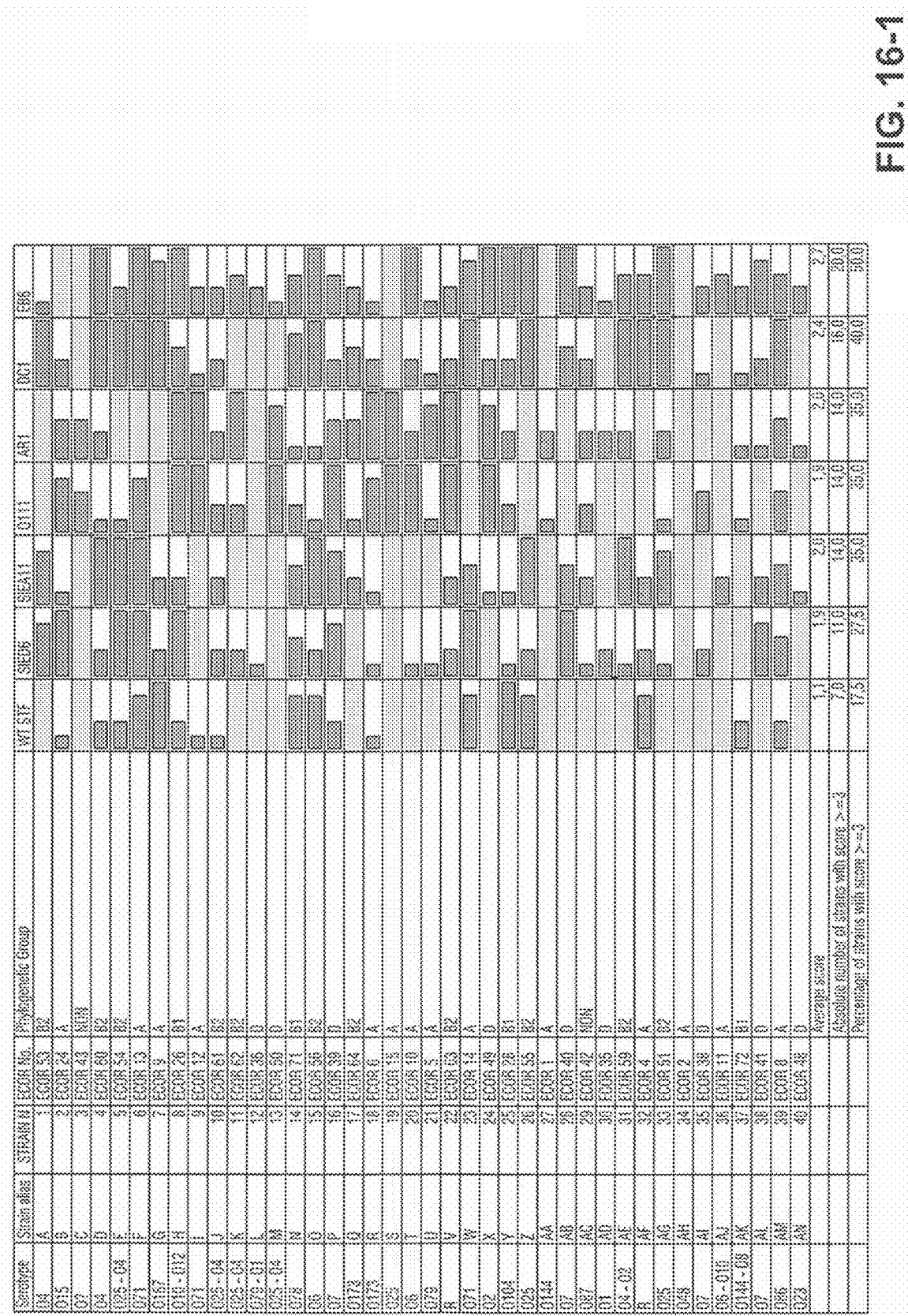
Figures 2, 16:
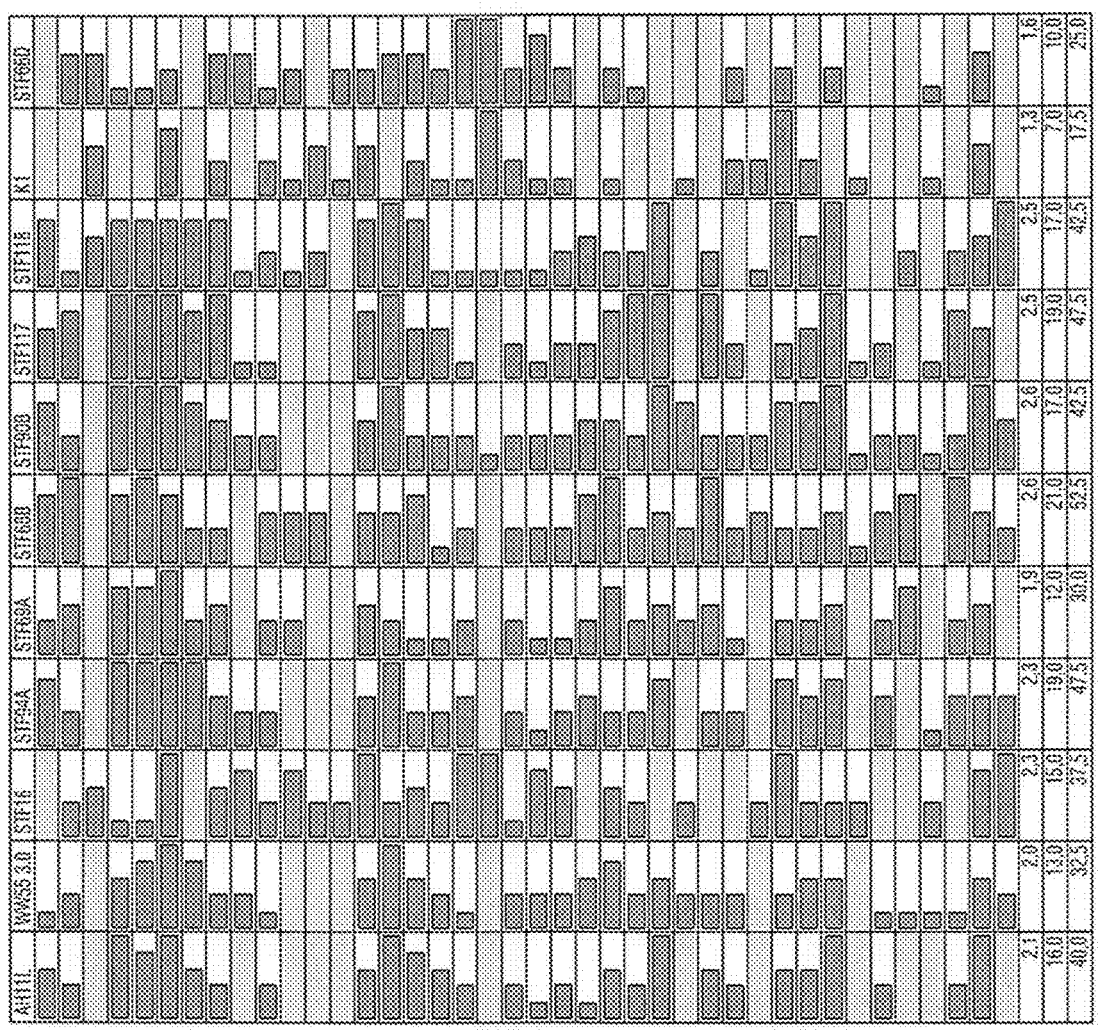

FIG. 16-1, FIG. 16-2 represents bar-formatted delivery data of FIG. 15-1, FIG. 15-2, FIG. 15-3. From 0 (no entry, grey background) to 5 (maximum delivery). The bar length is proportional to the entry score from 1 (smallest bars) to 5 (longest bars).

DETAILED DESCRIPTION

Disclosed herein are novel approaches to engineering synthetic bacterial delivery vehicles with desired target host ranges. The synthetic bacterial delivery vehicles are characterized by a chimeric receptor binding protein (RBP), wherein the chimeric RBP comprises a fusion between the N-terminal domain of a RBP from a lambda-like bacteriophage, or lambda bacteriophage, and the C-terminal domain of a different RBP. It has been demonstrated herein that a significant portion of a lambda-like RBP, such as a stf protein, can be exchanged with a portion of a different RBP. Moreover, specific fusion positions of the receptor binding protein have been identified which allow one to obtain a functional chimeric RBP.

Additionally, disclosed herein are synthetic bacterial delivery vehicles that are characterized by the presence of an engineered branched receptor binding multi-subunit protein complex ("branched-RBP"). The engineered branched-RBP comprises two or more associated receptor binding proteins, derived from bacteriophages, which associate with one another based on the presence of interaction domains (IDs). Each of the polypeptide subunits are engineered to contain IDs that function as "anchors" for association of one subunit RBP with another. The association of one subunit with another can be non-covalent or covalent. In specific embodiments the branched-RBP may comprise multiple RBP subunits, including, for example, two, three, four, etc. subunits.

As used herein, a receptor binding protein or RBP is a polypeptide that recognizes, and optionally binds and/or modifies or degrades a substrate located on the bacterial outer envelope, such as, without limitation, bacterial outer membrane, LPS, capsule, protein receptor, channel, structure such as the flagellum, pili, secretion system. The substrate can be, without limitation, any carbohydrate or modified carbohydrate, any lipid or modified lipid, any protein or modified protein, any amino acid sequence, and any combination thereof. As used herein, a lambda-like bacteriophage refers to any bacteriophage encoding a RBP having amino acids sequence homology of around 35% identity for 45 amino acids or more, around 50% identify for 30 amino acids or more, or around 90% identity for 18 amino acids or more in one or more of three amino acids regions ranging from positions 1-150, 320-460, and 495-560 with reference to the lambda bacteriophage stf sequence of SEQ ID NO: 1, independently of other amino acids sequences encoded by said bacteriophage.

The present disclosure provides a chimeric receptor binding protein (RBP), wherein the chimeric RBP comprises a fusion between an N-terminal domain of a RBP from a lambda-like bacteriophage, or lambda bacteriophage, and a C-terminal domain of a different bacteriophage RBP. Such bacteriophage RBPs, from which the chimeric RBP are derived, include, for example, "L-shape fibers", "side tail fibers (stfs)", "long tail fibers" or "tailspikes." As disclosed herein, it has been demonstrated that a significant portion of a lambda-like bacteriophage receptor binding protein (RBP), such as a stf protein, can be exchanged with a portion of a different RBP. Moreover, specific fusion positions in the RBPs have been identified which allow one to obtain a functional chimeric RBP. Such chimeric RBPs include those having an altered host range and/or biological activity such as, for example, depolymerase activity.

The chimeric receptor binding protein (RBP) is one wherein the chimeric RBP comprises a fusion between an N-terminal domain of a RBP derived from a lambda-like bacteriophage, or lambda bacteriophage, and a C-terminal domain of a different RBP wherein said N-terminal domain of the RBP is fused to said C-terminal domain of a different RBP within one of the amino acids regions selected from positions 1-150, 320-460, or 495-560 of the N-terminal RBP with reference to the lambda stf sequence (SEQ ID NO: 1) or a similar region of a RBP having homology with one or more of three amino acids regions ranging from positions 1-150, 320-460, and 495-560 of the RBP with reference to the lambda stf sequence (SEQ ID NO:1). In one specific aspect of the invention, the different RBP of the chimeric receptor binding protein (RBP) is derived from any bacteriophage or from any bacteriocin.

In one specific aspect, the RBP from the lambda-like bacteriophage, the lambda bacteriophage, or the different RBP contain homology with one or more of three amino acids regions ranging from positions 1-150, 320-460, and 495-560 of the RBP with reference to the lambda bacteriophage stf sequence (SEQ ID NO:1). In certain aspects, the homology between the lambda-like bacteriophage, the lambda bacteriophage, or the different RBP and the one or more amino acids regions is around 35% identity for 45 amino acids or more, around 50% identify for 30 amino acids or more, and around 90% identity for 18 amino acids or more. Determination of homology can be performed using alignment tools such as the Smith-Waterman algorithm (Smith et al., 1981, J. Mol. Biol 147:195-197) or EMBOSS Matcher (Rice, Longden, Bleasby 2000 EMBOSS Trends in Genetics 16: 276-277). In one aspect of the invention, the chimeric RBP comprises the N-terminal domain of the chimeric RBP fused to the C-terminal domain of the chimeric RBP within one of the amino acids regions selected from positions 80-150, 320-460, or 495-560 with reference to the lambda bacteriophage stf sequence (SEQ ID NO: 1). In another embodiment of the invention, the chimeric RBP comprises an N-terminal domain and a C-terminal domain fused within one of the three amino acids regions at an insertion site having at least 80%, preferably at least 85%, at least 90%, at least 95%, at least 98% or at least 99%, identity with an insertion site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203), preferably from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194). In a specific embodiment, where branched-RBPs comprise such chimeric RBPs, IDs may be inserted at such insertion sites thereby acting to fuse the N-terminal domain to the C-terminal domain.

In some instances, an ID domain may be fused to either an N-terminal domain, or C-terminal domain, of a bacteriophage RBP, to provide a non-chimeric protein subunit of an engineered branched RBP. The N-terminal domain, or C-terminal domain, may be chosen depending on the desired function of the domain, e.g. host range or biological function. Where such non-chimeric protein subunits are utilized for production of an engineered branched-RBP, the ID domain may be fused at the preferred insertion sites disclosed herein, or alternatively, at insertion sites that permit maintainance of the function of the chosen domain.

In specific embodiments, the disclosure provides chimeric RBPs. Such chimeric RBPs may function as protein subunits of an engineered branched-RBP protein complex. SEQ ID NOS 2-61, 135-165, 215-242, 271, 273, 282 and 283 disclose the amino acid sequences of such chimeric RBPs and in addition, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 135 to 144, 147, 150, 151, 154, 157, 160, 163, 215, 216, 219, 221, 223, 225, 227, 229, 232, 325, 237, 239, 241, 282 or 283. In a more specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56 or 59.

In one aspect, the present disclosure also provides nucleotide sequences encoding for the chimeric RBPs disclosed herein. In a specific embodiment, nucleic acids encoding such chimeric RBPs, as well as corresponding AP proteins, are depicted in SEQ ID NOS 62-120, 166-189, 206-212, 243-270, 272, 274 and 284. In a specific embodiment, the nucleic acids encoding the chimeric RBP comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 166, 167, 168, 171, 174, 175, 178, 181, 184, 187, 206, 207, 208, 209, 210, 211, 212, 243, 244, 247, 249, 251, 253, 255, 257, 260, 263, 265, 267, 269 or 284. In a more specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, or 119.

In aspects where the above described chimeric RBPs are utilized as subunits for production of branched RBP protein complexes, said chimeric RBPs may be further engineered to contain ID domains that act to mediate the association of the various engineered branched-RBP protein subunits with one another.

In one specific non-limiting aspect of the disclosure, it has been demonstrated that engineering the chimeric RBP to encode depolymerase activity can dramatically increase the delivery efficiency of the provided bacterial delivery vehicles comprising the chimeric RBP disclosed herein. In an embodiment of the disclosure, the different RBP domain of the chimeric RBP comprises depolymerase activity against an encapsulated bacterial strain. In a specific embodiment, the depolymerase is an endosialidase such as, for example, a K1F or K5 endosialidase With regard to the engineered branched-RBPs disclosed herein, any of the chimeric RBPs disclosed herein may be used as RBP subunits, wherein said RBPs may be further engineered to contain IDs. As disclosed in the Examples section, it has been demonstrated that engineering branched-RBPs can alter the host range of the resulting delivery particle.

Nucleic acid molecules encoding the chimeric RBPs and branched-RBPs, disclosed herein are provided. Such nucleic acids may be included in vectors such as bacteriophages, plasmids, phagemids, viruses, and other vehicles which enable transfer and expression of the chimeric RBP encoding nucleic acids.

Bacterial delivery vehicles are provided which enable transfer of a nucleic acid payload, encoding a protein or nucleic acid of interest, into a desired target bacterial host cell. Such bacterial delivery vehicles are characterized by having a chimeric RBP comprising a fusion between the N-terminal domain of a RBP from a lambda-like bacteriophage, or lambda bacteriophage, and the C-terminal domain of a different RBP. In an embodiment of the invention, the bacterial delivery vehicles contain a chimeric RBP comprising a fusion between an N-terminal domain of a RBP derived from a lambda-like bacteriophage, or lambda bacteriophage, and a C-terminal domain of a different RBP wherein said N-terminal domain of the chimeric RBP is fused to said C-terminal domain of a different RBP within one of the amino acids regions selected from positions 1-150, 320-460, or 495-560 of the N-terminal domain RBP with reference to the lambda stf sequence (SEQ ID NO: 1). In one aspect, the RBP from the lambda-like bacteriophage, the lambda bacteriophage, and the different RBP contain homology in one or more of three amino acids regions ranging from positions 1-150, 320-460, and 495-560 of the N-terminal RBP with reference to the lambda bacteriophage stf sequence. In certain aspects, the homology is around 35% identity for 45 amino acids or more, around 50% identify for 30 amino acids or more, or around 90% identity for 18 amino acids or more within the one or more of three amino acids regions ranging from positions 1-150, 320-460, and 495-560 of the N-terminal RBP with reference to the lambda bacteriophage stf sequence (SEQ ID NO: 1). In one specific aspect of the invention, the different RBP domain of the chimeric receptor binding protein (RBP) is derived from a bacteriophage or a bacteriocin. In one aspect of the invention, the chimeric RBP comprises an N-terminal domain of a RBP fused to a C-terminal domain of a RBP within one of the amino acids regions selected from 80-150, 320-460, or 495-560 of the RBPs with reference to the lambda stf sequence (SEQ ID NO: 1). In another embodiment of the invention, the chimeric RBP comprises an N-terminal domain of a RBP and a C-terminal domain of a RBP fused within a site of the N-terminal RBPs having at least 80%, preferably at least 85%, at least 90%, at least 95%, at least 98% or at least 99%, identity with a site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203), preferably selected from the group consisting of amino acids SAGDAS (SEQ ID NO:190), ADAKKS (SEQ ID NO:191), MDETNR (SEQ ID NO:192), SASAAA (SEQ ID NO:193), and GAGENS (SEQ ID NO:194).

In specific embodiments, the disclosure provides a bacterial delivery vehicle comprising a chimeric RBP. SEQ ID NOS 2-61, 135-165, 215-242, 271, 273, 282 and 283 disclose the amino acid sequences of such chimeric RBPs and in addition, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 135 to 144, 147, 150, 151, 154, 157, 160, 163, 215, 216, 219, 221, 223, 225, 227, 229, 232, 325, 237, 239, 241, 282 or 283. In a more specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56 or 59.

In one aspect, the present disclosure also provides nucleotide sequences encoding for the chimeric RBPs disclosed herein. In a specific embodiment, nucleic acids encoding such chimeric RBPs, as well as corresponding AP proteins, are depicted in SEQ ID NOS 62-120, 166-189, 206-212, 243-270, 272, 274 and 284. In a specific embodiment, the nucleic acids encoding the chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 166, 167, 168, 171, 174, 175, 178, 181, 184, 187, 206, 207, 208, 209, 210, 211, 212, 243, 244, 247, 249, 251, 253, 255, 257, 260, 263, 265, 267, 269 or 284. In a more specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, or 119

In other specific embodiments and to increase the delivery efficiency of the bacterial delivery vehicles disclosed herein the different RBP domain of the chimeric RBP comprises a domain having depolymerase activity against an encapsulated bacterial strain. In a specific embodiment, the depolymerase is an endosialidase, such as for example, a K1F or K5 endosialidase.

The present disclosure provides synthetic bacterial delivery vehicles that are characterized by the presence of an engineered branched receptor binding multi-subunit protein complex ("branched-RBP"). The engineered branched-RBP comprises two or more associated receptor binding proteins, derived from bacteriophages, which associate with one another based on the presence of interaction domains (IDs). The association of one subunit with another can be non-covalent or covalent. Each of the polypeptide subunits contain IDs that function as "anchors" for association of one subunit RBP with another. In specific embodiments the branched-RBP may comprise multiple RBP subunits, including, for example, two, three, four, etc. subunits.

The individual RBP subunit may bring different biological functions to the overall engineered branched-RBP. Such functions include, but are not limited to host recognition and enzymatic activity. Such enzymatic activity includes depolymerase activity.

Disclosed herein are amino acid sequences that are able to function as ID polypeptides. Such IDs, for purposes of the present invention, are those amino acid sequences that provide for non-covalent or covalent association of one receptor binding protein to another. An interaction domain is a polypeptide whose function mediates the association of one biological molecule, e.g., a protein, to another biological molecule. As a non limiting example, the biological molecule can be a protein, a part of a protein, a carbohydrate, a lipid and a nucleic acid.

The IDs may be naturally occurring bacteriophage IDs, IDs derived from non-bacteriophage polypeptides that naturally associate with one another, or recombinantly derived IDs that function to mediate non-covalent or covalent association of two proteins or polypeptide domains.

The two or more associated receptor binding proteins of the branched-RBP include, but are not limited to, chimeric receptor binding proteins (RBPs) described herein that comprise a fusion between the N-terminal domain of a RBP derived from a lambda-like, or lambda bacteriophage and the C-terminal domain of a different RBP wherein said chimeric RBP further comprises an ID domain.

With regard to IDs, such sequences are linked to receptor binding proteins (RBPs), e.g. can be fusion, can be coiled coil, can be a non-covalent interaction or can be natural sequence of the RBP. An RBP subunit of the branched-RBP may be a polypeptide that recognizes, and optionally binds and/or modifies or degrades a substrate located on the bacterial outer envelope, such as, without limitation, bacterial outer membrane, LPS, capsule, protein receptor, channel, structure such as the flagellum, pili, secretion system. The substrate can be, without limitation, any carbohydrate or modified carbohydrate, any lipid or modified lipid.

The bacterial delivery vehicles provided herein enable transfer of a nucleic acid payload, encoding a protein or nucleic acid of interest, into a desired target bacterial host cell. As used herein, the term "delivery vehicle" refers to any means that allows the transfer of a payload into a bacterium. There are several types of delivery vehicles encompassed by the present invention including, without limitation, bacteriophage scaffold, virus scaffold, chemical based delivery vehicle (e.g., cyclodextrin, calcium phosphate, cationic polymers, cationic liposomes), protein-based or peptide-based delivery vehicle, lipid-based delivery vehicle, nanoparticle-based delivery vehicles, non-chemical-based delivery vehicles (e.g., transformation, electroporation, sonoporation, optical transfection), particle-based delivery vehicles (e.g., gene gun, magnetofection, impalefection, particle bombardment, cell-penetrating peptides) or donor bacteria (conjugation). Any combination of delivery vehicles is also encompassed by the present invention. The delivery vehicle can refer to a bacteriophage derived scaffold and can be obtained from a natural, evolved or engineered capsid. In some embodiments, the delivery vehicle is the payload as bacteria are naturally competent to take up a payload from the environment on their own.

Delivery vehicles as disclosed herein include packaged phagemids, as well as bacteriophage, comprising the chimeric and/or branched-RBPs disclosed herein. The engineering of such delivery vehicles are well known to those skilled in the art. Such engineering techniques may employ production cell lines engineered to express the chimeric RBPs or branched-RBP disclosed herein. Generation of packaged phagemids and bacteriophage particles are routine techniques well-known to one skilled in the art. A satellite phage and/or helper phage may be used to promote the packaging of the payload in delivery vehicles of the present invention. Helper phages provide functions in trans and are well known to the man skilled in the art. The helper phage comprises all the genes coding for the structural and functional proteins that are indispensable for the payload to be packaged, according to the invention (i.e. the helper phage provides all the necessary gene products for the assembly of the delivery vehicle). The helper phage may contain a defective origin of replication or packaging signal, or completely lack the latter, and hence it is uncapable of self-packaging, thus only bacterial delivery particles carrying the payload or plasmid will be produced. Helper phages may be chosen so that they cannot induce lysis of the host used for the delivery particle production. One skilled in the art would understand that some bacteriophages are defective and need a helper phage for payload packaging. Thus, depending on the bacteriophage chosen in connection with the present invention to prepare the bacterial delivery particles, the person skilled in the art would know if a helper phage is required. Sequences coding for one or more proteins or regulatory processes necessary for the assembly or production of packaged payloads may be supplied in trans. For example, the RBPs of the present disclosure may be provided in a plasmid under the control of an inducible promoter or expressed constitutively. In this case, the phage wild-type sequence may or not contain a deletion of the gene or sequence supplied in trans. Additionally, chimeric or modified phage sequences encoding a new function, like a RBP, may be directly inserted into the desired position in the genome of the helper phage, hence bypassing the necessity of providing the modified sequence in trans. Methods for both supplying a sequence or protein in trans in the form of a plasmid, as well as methods to generate direct genomic insertions, modifications and mutations are well known to those skilled in the art.

As used herein, the term "payload" refers to any nucleic acid sequence or amino acid sequence, or a combination of both (such as, without limitation, peptide nucleic acid or peptide-oligonucleotide conjugate) transferred into a bacterium with a delivery vehicle. The term "payload" may also refer to a plasmid, a vector or a cargo. The payload can be a phagemid or plasmid obtained from natural, evolved or engineered bacteriophage genome. The payload can also be composed only in part of phagemid or plasmid obtained from natural, evolved or engineered bacteriophage genome.

As used herein, the term "nucleic acid" refers to a sequence of at least two nucleotides covalently linked together which can be single-stranded or double-stranded or contains portion of both single-stranded and double-stranded sequence. Nucleic acids of the present invention can be naturally occurring, recombinant or synthetic. The nucleic acid can be in the form of a circular sequence or a linear sequence or a combination of both forms. The nucleic acid can be DNA, both genomic or cDNA, or RNA or a combination of both. The nucleic acid may contain any combination of deoxyribonucleotides and ribonucleotides, and any combination of bases, including uracil, adenine, thymine, cytosine, guanine, inosine, xathanine, hypoxathanine, isocytosine, 5-hydroxymethylcytosine and isoguanine. Other examples of modified bases that can be used in the present invention are detailed in Chemical Reviews 2016, 116 (20) 12655-12687. The term "nucleic acid" also encompasses any nucleic acid analogs which may contain other backbones comprising, without limitation, phosphoramide, phosphorothioate, phosphorodithioate, O-methylphophoroamidite linkage and/or deoxyribonucleotides and ribonucleotides nucleic acids. Any combination of the above features of a nucleic acid is also encompassed by the present invention.

Origins of replication known in the art have been identified from species-specific plasmid DNAs (e.g. ColE1, R1, pT181, pSC101, pMB1, R6K, RK2, p15a and the like), from bacterial virus (e.g. φX174, M13, F1 and P4) and from bacterial chromosomal origins of replication (e.g. oriC). In one embodiment, the phagemid according to the disclosure comprises a bacterial origin of replication that is functional in the targeted bacteria.

Alternatively, the plasmid according to the disclosure does not comprise any functional bacterial origin of replication or contain an origin of replication that is inactive in the targeted bacteria. Thus, the plasmid of the disclosure cannot replicate by itself once it has been introduced into a bacterium by the bacterial virus particle.

In one embodiment, the origin of replication on the plasmid to be packaged is inactive in the targeted bacteria, meaning that this origin of replication is not functional in the bacteria targeted by the bacterial virus particles, thus preventing unwanted plasmid replication.

In one embodiment, the plasmid comprises a bacterial origin of replication that is functional in the bacteria used for the production of the bacterial virus particles.

Plasmid replication depends on host enzymes and on plasmid-controlled cis and trans determinants. For example, some plasmids have determinants that are recognized in almost all gram-negative bacteria and act correctly in each host during replication initiation and regulation. Other plasmids possess this ability only in some bacteria (Kues, U and Stahl, U 1989 Microbiol Rev 53:491-516).

Plasmids are replicated by three general mechanisms, namely theta type, strand displacement, and rolling circle (reviewed by Del Solar et al. 1998 Microhio and Molec Biol. Rev 62:434-464) that start at the origin of replication. These replication origins contain sites that are required for interactions of plasmid and/or host encoded proteins.

Origins of replication used on the plasmid of the disclosure may be of moderate copy number, such as colE1 ori from pBR322 (15-20 copies per cell) or the R6K plasmid (15-20 copies per cell) or may be high copy number, e.g. pUC oris (500-700 copies per cell), pGEM oris (300-400 copies per cell), pTZ oris (>1000 copies per cell) or pBluescript oris (300-500 copies per cell).

In one embodiment, the bacterial origin of replication is selected in the group consisting of ColE1, pMB1 and variants (pBR322, pET, pUC, etc.), p15a, ColA, ColE2, pOSAK, pSC101, R6K, IncW (pSa etc.), IncFII, pT181, P1, F IncP, IncC, IncJ, IncN, IncP1, IncP4, IncQ, IncH11, RSF1010, CloDF13, NTP16, R1, f5, pPS10, pC194, pE194, BBR1, pBC1, pEP2, pWVO1, pLF1311, pAP1, pWKS1, pLS1, pLS11, pUB6060, pJD4, pIJ101, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

More preferably, the bacterial origin of replication is a E. coli origin of replication selected in the group consisting of ColE1, pMB1 and variants (pBR322, pET, pUC, etc.), p15a, ColA, ColE2, pOSAK, pSC101, R6K, IncW (pSa etc.), IncFII, pT181, P1, F IncP, IncC, IncJ, IncN, IncP1, IncP4, IncQ, IncH11, RSF1010, CloDF13, NTP16, R1, f5 and pPS10.

More preferably, the bacterial origin of replication is selected in the group consisting of pC194, pE194, BBR1, pBC1, pEP2, pWVO1, pLF1311, pAP1, pWKS1, pLS1, pLS11, pUB6060, pJD4, pIJ101, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

Even more preferably, the bacterial origin of replication is ColE1.

The delivered nucleic acid sequence according to the disclosure may comprise a phage replication origin which can initiate, with complementation of a complete phage genome, the replication of the delivered nucleic acid sequence for later encapsulation into the different capsids.

A phage origin of replication comprised in the delivered nucleic acid sequence of the disclosure can be any origin of replication found in a phage.

Preferably, the phage origin of replication can be the wild-type or non-wildtype sequence of the M13, f1, φX174, P4, lambda, P2, lambda-like, HK022, mEP237, HK97, HK629, HK630, mEP043, mEP213, mEP234, mEP390, mEP460, mEPx1, mEPx2, phi80, mEP234, T2, T4, T5, T7, RB49, phiX174, R17, PRD1 P1-like, P2-like, P22, P22-like, N15 and N15-like bacteriophages.

More preferably, the phage origin of replication is selected in the group consisting of phage origins of replication of M13, f1, φX174, P4, and lambda.

In a particular embodiment, the phage origin of replication is the lambda or P4 origin of replication.

The delivered nucleic acid of interest comprises a nucleic acid sequence under the control of a promoter. In certain embodiments of the invention, the nucleic acid of interest is selected from the group consisting of a Cas nuclease gene, a Cas9 nuclease gene, a guide RNA, a CRISPR locus, a toxin gene, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor, and a gene expressing a virulence protein or a virulence factor, or any of their combination. In an embodiment of the invention, the nucleic acid payload encodes a therapeutic protein. In another embodiment, the nucleic acid payload encodes an anti-sense nucleic acid molecule.

In one embodiment, the sequence of interest is a programmable nuclease circuit to be delivered to the targeted bacteria. This programmable nuclease circuit is able to mediate in vivo sequence-specific elimination of bacteria that contain a target gene of interest (e.g. a gene that is harmful to humans). Some embodiments of the present disclosure relate to engineered variants of the Type II CRISPR-Cas (Clustered Regularly Interspaced Short Palindromic Repeats-CRISPR-associated) system of *Streptococcus pyogenes*. Other programmable nucleases that can be used include other CRISPR-Cas systems, engineered TALEN (Transcription Activator-Like Effector Nuclease) variants, engineered zinc finger nuclease (ZFN) variants, natural, evolved or engineered meganuclease or recombinase variants, and any combination or hybrids of programmable nucleases. Thus, the engineered autonomously distributed nuclease circuits provided herein may be used to selectively cleave DNA encoding a gene of interest such as, for example, a toxin gene, a virulence factor gene, an antibiotic resistance gene, a remodeling gene or a modulatory gene (cf. WO2014124226).

Other sequences of interest, preferably programmable, can be added to the delivered nucleic acid sequence so as to be delivered to targeted bacteria. Preferably, the sequence of interest added to the delivered nucleic acid sequence leads to cell death of the targeted bacteria. For example, the nucleic acid sequence of interest added to the plasmid may encode holins or toxins.

Alternatively, the sequence of interest circuit added to the delivered nucleic acid sequence does not lead to bacteria death. For example, the sequence of interest may encode reporter genes leading to a luminescence or fluorescence signal. Alternatively, the sequence of interest may comprise proteins and enzymes achieving a useful function such as modifying the metabolism of the bacteria or the composition of its environment.

In a particular embodiment, the nucleic sequence of interest is selected in the group consisting of Cas9, a single guide RNA (sgRNA), a CRISPR locus, a gene expressing an enzyme such as a nuclease or a kinase, a TALEN, a ZFN, a meganuclease, a recombinase, a bacterial receptor, a membrane protein, a structural protein, a secreted protein, resistance to an antibiotic or to a drug in general, a gene expressing a toxic protein or a toxic factor and a gene expressing a virulence protein or a virulence factor.

In a particular embodiment, the delivered nucleic acid sequence according to the disclosure comprises a nucleic acid sequence of interest that encodes a bacteriocin, which can be a proteinaceous toxin produced by bacteria to kill or inhibit growth of other bacteria. Bacteriocins are categorized in several ways, including producing strain, common resistance mechanisms, and mechanism of killing. Such bacteriocin had been described from gram negative bacteria (e.g. microcins, colicin-like bacteriocins and tailocins) and from gram positive bacteria (e.g. Class I, Class II, Class III or Class IV bacteriocins).

In one embodiment, the delivered nucleic acid sequence according to the disclosure further comprises a sequence of interest encoding a toxin selected in the group consisting of microcins, colicin-like bacteriocins, tailocins, Class I, Class II, Class III and Class IV bacteriocins.

In a particular embodiment, the corresponding immunity polypeptide (i.e. anti-toxin) may be used to protect bacterial cells (Cotter et al., Nature Reviews Microbiology 11: 95, 2013) for delivered nucleic acid sequence production and encapsidation purpose but is absent in the pharmaceutical composition and in the targeted bacteria in which the delivered nucleic acid sequence of the disclosure is delivered.

In one aspect of the disclosure, the CRISPR system is included in the delivered nucleic acid sequence. The CRISPR system contains two distinct elements, i.e. i) an endonuclease, in this case the CRISPR associated nuclease (Cas or "CRISPR associated protein") and ii) a guide RNA. The guide RNA is in the form of a chimeric RNA which consists of the combination of a CRISPR (RNAcr) bacterial RNA and a RNAtracr (trans-activating RNA CRISPR) (Jinek et al., 2012, Science 337: 816-821). The guide RNA combines the targeting specificity of the RNAcr corresponding to the "spacing sequences" that serve as guides to the Cas proteins, and the conformational properties of the RNAtracr in a single transcript. When the guide RNA and the Cas protein are expressed simultaneously in the cell, the target genomic sequence can be permanently modified or interrupted. The modification is advantageously guided by a repair matrix. In general, the CRISPR system includes two main classes depending on the nuclease mechanism of action. Class 1 is made of multi-subunit effector complexes and includes type I, III and IV. Class 2 is made of single-unit effector modules, like Cas9 nuclease, and includes type II (II-A, II-B, II-C, II-C variant), V (V-A, V-B, V-C, V-D, V-E, V-U1, V-U2, V-U3, V-U4, V-U5) and VI (VI-A, VI-B1, VI-B2, VI-C, VI-D)

The sequence of interest according to the present disclosure comprises a nucleic acid sequence encoding Cas protein. A variety of CRISPR enzymes are available for use as a sequence of interest on the plasmid. In some embodiments, the CRISPR enzyme is a Type II CRISPR enzyme. In some embodiments, the CRISPR enzyme catalyzes DNA cleavage. In some other embodiments, the CRISPR enzyme catalyzes RNA cleavage. In one embodiment, the CRISPR enzymes may be coupled to a sgRNA. In certain embodiments, the sgRNA targets a gene selected in the group consisting of an antibiotic resistance gene, virulence protein or factor gene, toxin protein or factor gene, a bacterial receptor gene, a membrane protein gene, a structural protein gene, a secreted protein gene and a gene expressing resistance to a drug in general.

Non-limiting examples of Cas proteins as part of a multi-subunit effector or as a single-unit effector include Cas1, Cas1B, Cas2, Cas3, Cas4, Cas5, Cash, Cas7, Cas8, Cas9 (also known as Csn1 and Csx12), Cas10, Cas11 (SS), Cas12a (Cpf1), Cas12b (C2c1), Cas12c (C2c3), Cas12d (CasY), Cas12e (CasX), C2c4, C2c8, C2c5, C2c10, C2c9, Cas13a (C2c2), Cas13b (C2c6), Cas13c (C2c7), Cas13d, Csa5, Csc1, Csc2, Cse1, Cse2, Csy1, Csy2, Csy3, Csf1, Csf2, Csf3, Csf4, Csm2, Csm3, Csm4, Csm5, Csm6, Cmr1, Cmr3, Cmr4, Cmr5, Cmr6, Csn2, Csb1, Csb2, Csb3, Csx17, Csx14, Csx10, Csx16, CsaX, Csx13, Csx1, Csx15, SdCpf1, CmtCpf1, TsCpf1, CmaCpf1, PcCpf1, ErCpf1, FbCpf1, UbcCpf1, AsCpf1, LbCpf1, homologues thereof, orthologues thereof, variants thereof, or modified versions thereof. In some embodiments, the CRISPR enzyme cleaves both strands of the target nucleic acid at the Protospacer Adjacent Motif (PAM) site.

In a particular embodiment, the CRISPR enzyme is any Cas9 protein, for instance any naturally-occurring bacterial Cas9 as well as any variants, homologs or orthologs thereof.

By "Cas9" is meant a protein Cas9 (also called Csn1 or Csx12) or a functional protein, peptide or polypeptide fragment thereof, i.e. capable of interacting with the guide RNA(s) and of exerting the enzymatic activity (nuclease) which allows it to perform the double-strand cleavage of the DNA of the target genome. "Cas9" can thus denote a modified protein, for example truncated to remove domains of the protein that are not essential for the predefined functions of the protein, in particular the domains that are not necessary for interaction with the gRNA(s).

The sequence encoding Cas9 (the entire protein or a fragment thereof) as used in the context of the disclosure can be obtained from any known Cas9 protein (Fonfara et al., Nucleic Acids Res 42 (4), 2014; Koonin et al., Nat Rev Microbiol 15(3), 2017). Examples of Cas9 proteins useful in the present disclosure include, but are not limited to, Cas9 proteins of *Streptococcus pyogenes* (SpCas9), *Streptococcus thermophilus* (St1Cas9, St3Cas9), *Streptococcus mutans*, *Staphylococcus aureus* (SaCas9), *Campylobacter jejuni* (CjCas9), *Francisella novicida* (FnCas9) and *Neisseria meningitides* (NmCas9).

The sequence encoding Cpf1 (Cas12a) (the entire protein or a fragment thereof) as used in the context of the disclosure can be obtained from any known Cpf1 (Cas12a) protein (Koonin et al., Nat Rev Microbiol 15(3), 2017). Examples of Cpf1(Cas12a) proteins useful in the present disclosure include, but are not limited to, Cpf1(Cas12a) proteins of *Acidaminococcus* sp, *Lachnospiraceae bacteriu* and *Francisella novicida*.

The sequence encoding Cas13a (the entire protein or a fragment thereof) can be obtained from any known Cas13a (C2c2) protein (Abudayyeh et al., 2017, Nature 550: 280-284). Examples of Cas13a (C2c2) proteins useful in the present disclosure include, but are not limited to, Cas13a (C2c2) proteins of *Leptotrichia wadei* (LwaCas13a).

The sequence encoding Cas13d (the entire protein or a fragment thereof) can be obtained from any known Cas13d protein (Yan et al., 2018, Mol Cell 70: 327-339). Examples of Cas13d proteins useful in the present disclosure include, but are not limited to, Cas13d proteins of *Eubacterium siraeum* and *Ruminococcus* sp.

In a particular embodiment, the nucleic sequence of interest is a CRISPR/Cas9 system for the reduction of gene expression or inactivation of a gene selected in the group consisting of an antibiotic resistance gene, virulence factor or protein gene, toxin factor or protein gene, a gene expressing a bacterial receptor, a membrane protein, a structural protein, a secreted protein, and a gene expressing resistance to a drug in general.

In one embodiment, the CRISPR system is used to target and inactivate a virulence factor. A virulence factor can be any substance produced by a pathogen that alter host-pathogen interaction by increasing the degree of damage done to the host. Virulence factors are used by pathogens in many ways, including, for example, in cell adhesion or colonization of a niche in the host, to evade the host's immune response, to facilitate entry to and egress from host cells, to obtain nutrition from the host, or to inhibit other physiological processes in the host. Virulence factors can include enzymes, endotoxins, adhesion factors, motility factors, factors involved in complement evasion, and factors that promote biofilm formation. For example, such targeted virulence factor gene can be *E. coli* virulence factor gene such as, without limitation, EHEC-HlyA, Stx1 (VT1), Stx2 (VT2), Stx2a (VT2a), Stx2b (VT2b), Stx2c (VT2c), Stx2d (VT2d), Stx2e (VT2e) and Stx2f (VT2f), Stx2h (VT2h), fimA, fimF, fimH, neuC, kpsE, sfa, foc, iroN, aer, iha, papC, papGI, papGII, papGIII, hlyC, cnf1, hra, sat, ireA, usp ompT, ibeA, malX, fyuA, irp2, traT, afaD, ipaH, eltB, estA, bfpA, eaeA, espA, aaiC, aatA, TEM, CTX, SHV, csgA, csgB, csgC, csgD, csgE, csgF, csgG, csgH, T1SS, T2SS, T3SS, T4SS, T5SS, T6SS (secretion systems). For example, such targeted virulence factor gene can be *Shigella dysenteriae* virulence factor gene such as, without limitation, stx1 and stx2. For example, such targeted virulence factor gene can be *Yersinia pestis* virulence factor gene such as, without limitation, yscF (plasmid-borne (pCD1) T3SS external needle subunit). For example, such targeted virulence factor gene can be *Francisella tularensis* virulence factor gene such as, without limitation, fs1A. For example, such targeted virulence factor gene can be *Bacillus anthracis* virulence factor gene such as, without limitation, pag (Anthrax toxin, cell-binding protective antigen). For example, such targeted virulence factor gene can be *Vibrio cholera* virulence factor gene such as, without limitation, ctxA and ctxB (cholera toxin), tcpA (toxin co-regulated pilus), and toxT (master virulence regulator). For example, such targeted virulence factor gene can be *Pseudomonas aeruginosa* virulence factor genes such as, without limitation, pyoverdine (e.g., sigma factor pvdS, biosynthetic genes pvdL, pvdl, pvdJ, pvdH, pvdA, pvdF, pvdQ, pvdN, pvdM, pvdO, pvdP, transporter genes pvdE, pvdR, pvdT, opmQ), siderophore pyochelin (e.g., pchD, pchC, pchB, pchA, pchE, pchF and pchG, and toxins (e.g., exoU, exoS and exoT). For example, such targeted virulence factor gene can be *Klebsiella pneumoniae* virulence factor genes such as, without limitation, fimA (adherence, type I fimbriae major subunit), and cps (capsular polysaccharide). For example, such targeted virulence factor gene can be *Acinetobacter baumannii* virulence factor genes such as, without limitation, ptk (capsule polymerization) and epsA (assembly). For example, such targeted virulence factor gene can be *Salmonella enterica Typhi* virulence factor genes such as, without limitation, MIA (invasion, SPI-1 regulator), ssrB (SPI-2 regulator), and those associated with bile tolerance, including efflux pump genes acrA, acrB and tolC. For example, such targeted virulence factor gene can be *Fusobacterium nucleatum* virulence factor genes such as, without limitation, FadA and TIGIT. For example, such targeted virulence factor gene can be *Bacteroides fragilis* virulence factor genes such as, without limitation, bft.

In another embodiment, the CRISPR/Cas9 system is used to target and inactivate an antibiotic resistance gene such as, without limitation, GyrB, ParE, ParY, AAC(1), AAC(2'), AAC(3), AAC(6'), ANT(2"), ANT(3"), ANT(4'), ANT(6), ANT(9), APH(2"), APH(3"), APH(3'), APH(4), APH(6), APH(7"), APH(9), ArmA, RmtA, RmtB, RmtC, Sgm, AER, BLA1, CTX-M, KPC, SHV, TEM, BlaB, CcrA, IMP, NDM, VIM, ACT, AmpC, CMY, LAT, PDC, OXA β-lactamase, mecA, Omp36, OmpF, PIB, bla (bla1, blaR1) and mec (mecI, mecR1) operons, Chloramphenicol acetyltransferase (CAT), Chloramphenicol phosphotransferase, Ethambutol-resistant arabinosyltransferase (EmbB), MupA, MupB, Integral membrane protein MprF, Cfr 23 S rRNA methyltransferase, Rifampin ADP-ribosyltransferase (Arr), Rifampin glycosyltransferase, Rifampin monooxygenase, Rifampin phosphotransferase, DnaA, RbpA, Rifampin-resistant beta-subunit of RNA polymerase (RpoB), Erm 23S rRNA methyltransferases, Lsa, MsrA, Vga, VgaB, Streptogramin Vgb lyase, Vat acetyltransferase, Fluoroquinolone acetyltransferase, Fluoroquinolone-resistant DNA topoisomerases, Fluoroquinolone-resistant GyrA, GyrB, ParC, Quinolone resistance protein (Qnr), FomA, FomB, FosC, FosA, FosB, FosX, VanA, VanB, VanD, VanR, VanS, Lincosamide nucleotidyltransferase (Lin), EreA, EreB, GimA, Mgt, Ole, Macrolide phosphotransferases (MPH), MefA, MefE, Mel, Streptothricin acetyltransferase (sat), Sul1, Sul2, Sul3, sulfonamide-resistant FolP, Tetracycline inactivation enzyme TetX, TetA, TetB, TetC, Tet30, Tet31, TetM, TetO, TetQ, Tet32, Tet36, MacAB-TolC, MsbA, MsrA, VgaB, EmrD, EmrAB-TolC, NorB, GepA, MepA, AdeABC, AcrD, MexAB-OprM, mtrCDE, EmrE, adeR, acrR, baeSR, mexR, phoPQ, mtrR, or any antibiotic resistance gene described in the Comprehensive Antibiotic Resistance Database (CARD https://card.mcmaster.ca/).

In another embodiment, the CRISPR/Cas9 system is used to target and inactivate a bacterial toxin gene. Bacterial toxin can be classified as either exotoxins or endotoxins. Exotoxins are generated and actively secreted; endotoxins remain part of the bacteria. The response to a bacterial toxin can involve severe inflammation and can lead to sepsis. Such toxin can be for example Botulinum neurotoxin, Tetanus toxin, Staphylococus toxins, Diphteria toxin, Anthrax toxin, Alpha toxin, Pertussis toxin, Shiga toxin, Heat-stable enterotoxin (*E. coli* ST), colibactin, BFT (*B. fragilis* toxin) or any toxin described in Henkel et al., (Toxins from Bacteria in EXS. 2010; 100: 1-29).

The bacteria targeted by bacterial delivery vehicles disclosed herein can be any bacteria present in a mammal organism. In a certain aspect, the bacteria are targeted through interaction of the chimeric RBPs and/or the branched-RBPs expressed by the delivery vehicles with the bacterial cell. It can be any commensal, symbiotic or pathogenic bacteria of the microbiota or microbiome.

A microbiome may comprise of a variety of endogenous bacterial species, any of which may be targeted in accordance with the present disclosure. In some embodiments, the genus and/or species of targeted endogenous bacterial cells may depend on the type of bacteriophages being used for preparing the bacterial delivery vehicles. For example, some bacteriophages exhibit tropism for, or preferentially target, specific host species of bacteria. Other bacteriophages do not exhibit such tropism and may be used to target a number of different genus and/or species of endogenous bacterial cells.

Examples of bacterial cells include, without limitation, cells from bacteria of the genus *Yersinia* spp., *Escherichia* spp., *Klebsiella* spp., *Acinetobacter* spp., *Bordetella* spp., *Neisseria* spp., *Aeromonas* spp., *Franciesella* spp., *Corynebacterium* spp., *Citrobacter* spp., *Chlamydia* spp., *Hemophilus* spp., *Brucella* spp., *Mycobacterium* spp., *Legionella* spp., *Rhodococcus* spp., *Pseudomonas* spp., *Helicobacter* spp., *Vibrio* spp., *Bacillus* spp., *Erysipelothrix* spp., *Salmonella* spp., *Streptomyces* spp., *Streptococcus* spp., *Staphylococcus* spp., *Bacteroides* spp., *Prevotella* spp., *Clostridium* spp., *Bifidobacterium* spp., *Clostridium* spp., *Brevibacterium* spp., *Lactococcus* spp., *Leuconostoc* spp., *Actinobacillus* spp., *Selnomonas* spp., *Shigella* spp., *Zymonas* spp., *Mycoplasma* spp., *Treponema* spp., *Leuconostoc* spp., *Corynebacterium* spp., *Enterococcus* spp., *Enterobacter* spp., *Pyrococcus* spp., *Serratia* spp., *Morganella* spp., *Parvimonas* spp., *Fusobacterium* spp., *Actinomyces* spp., *Porphyromonas* spp., *Micrococcus* spp., *Bartonella* spp., *Borrelia* spp., *Brucelia* spp., *Campylobacter* spp., *Chlamydophilia* spp., *Cutibacterium* (formerly *Propionibacterium*) spp., *Ehrlichia* spp., *Haemophilus* spp., *Leptospira* spp., *Listeria* spp., *Mycoplasma* spp., *Nocardia* spp., *Rickettsia* spp., *Ureaplasma* spp., and *Lactobacillus* spp, and a mixture thereof.

Thus, bacterial delivery vehicles may target (e.g., specifically target) a bacterial cell from any one or more of the foregoing genus of bacteria to specifically deliver the payload of interest according to the disclosure.

Preferably, the targeted bacteria can be selected from the group consisting of *Yersinia* spp., *Escherichia* spp., *Klebsiella* spp., *Acinetobacter* spp., *Pseudomonas* spp., *Helicobacter* spp., *Vibrio* spp, *Salmonella* spp., *Streptococcus* spp., *Staphylococcus* spp., *Bacteroides* spp., *Clostridium* spp., *Shigella* spp., *Enterococcus* spp., *Enterobacter* spp., and *Listeria* spp.

In some embodiments, bacterial cells of the present disclosure are anaerobic bacterial cells (e.g., cells that do not require oxygen for growth). Anaerobic bacterial cells include facultative anaerobic cells such as but not limited to *Escherichia coli*, *Shewanella oneidensis* and *Listeria*. Anaerobic bacterial cells also include obligate anaerobic cells such as, for example, *Bacteroides* and *Clostridium* species. In humans, anaerobic bacteria are most commonly found in the gastrointestinal tract. In some particular embodiment, the targeted bacteria are thus bacteria most commonly found in the gastrointestinal tract. Bacteriophages used for preparing the bacterial virus particles, and then the bacterial virus particles, may target (e.g., to specifically target) anaerobic bacterial cells according to their specific spectra known by the person skilled in the art to specifically deliver the plasmid.

In some embodiments, the targeted bacterial cells are, without limitation, *Bacteroides thetaiotaomicron*, *Bacteroides fragilis*, *Bacteroides distasonis*, *Bacteroides vulgatus*, *Clostridium leptum*, *Clostridium coccoides*, *Staphylococcus aureus*, *Bacillus subtilis*, *Clostridium butyricum*, *Brevibacterium lactofermentum*, *Streptococcus agalactiae*, *Lactococcus lactis*, *Leuconostoc lactis*, *Actinobacillus actinobycetemcomitans*, cyanobacteria, *Escherichia coli*, *Helicobacter pylori*, *Selnomonas ruminatium*, *Shigella sonnei*, *Zymomonas mobilis*, *Mycoplasma mycoides*, *Treponema denticola*, *Bacillus thuringiensis*, *Staphilococcus lugdunensis*, *Leuconostoc oenos*, *Corynebacterium xerosis*, *Lactobacillus plantarum*, *Lactobacillus rhamnosus*, *Lactobacillus casei*, *Lactobacillus acidophilus*, *Enterococcus faecalis*, *Bacillus coagulans*, *Bacillus cereus*, *Bacillus popillae*, *Synechocystis* strain PCC6803, *Bacillus liquefaciens*, *Pyrococcus abyssi*, *Selenomonas nominantium*, *Lactobacillus hilgardii*, *Streptococcus fetus*, *Lactobacillus pentosus*, *Bacteroides fragilis*, *Staphylococcus epidermidis*, *Streptomyces phaechromogenes*, *Streptomyces ghanaenis*, *Klebsiella pneumoniae*, *Enterobacter cloacae*, *Enterobacter aerogenes*, *Serratia marcescens*, *Morganella morganii*, *Citrobacter freundii*, *Pseudomonas aerigunosa*, *Parvimonas micra*, *Prevotella intermedia*, *Fusobacterium nucleatum*, *Prevotella nigrescens*, *Actinomyces israelii*, *Porphyromonas endodontalis*, *Porphyromonas gingivalis Micrococcus luteus*, *Bacillus megaterium*, *Aeromonas hydrophila*, *Aeromonas caviae*, *Bacillus anthracis*, *Bartonella henselae*, *Bartonella Quintana*, *Bordetella pertussis*, *Borrelia burgdorferi*, *Borrelia garinii*, *Borrelia afzelii*, *Borrelia recurrentis*, *Brucella abortus*, *Brucella canis*, *Brucella melitensis*, *Brucella suis*, *Campylobacter jejuni*, *Campylobacter coli*, *Campylobacter fetus*, *Chlamydia pneumoniae*, *Chlamydia trachomatis*, *Chlamydophila psittaci*, *Clostridium botulinum*, *Clostridium difficile*, *Clostridium perfringens*, *Clostridium tetani*, *Corynebacterium diphtheria*, *Cutibacterium acnes* (formerly *Propionibacterium acnes*), *Ehrlichia canis*, *Ehrlichia chaffeensis*, *Enterococcus faecium*, *Francisella tularensis*, *Haemophilus influenza*, *Legionella pneumophila*, *Leptospira interrogans*, *Leptospira santarosai*, *Leptospira weilii*, *Leptospira noguchii*, *Listeria monocytogenes*, *Mycobacterium leprae*, *Mycobacterium tuberculosis*, *Mycobacterium ulcerans*, *Mycoplasma pneumonia*, *Neisseria gonorrhoeae*, *Neisseria meningitides*, *Nocardia asteroids*, *Rickettsia rickettsia*, *Salmonella enteritidis*, *Salmonella typhi*, *Salmonella paratyphi*, *Salmonella typhimurium*, *Shigella flexneri*, *Shigella dysenteriae*, *Staphylococcus saprophyticus*, *Streptococcus pneumoniae*, *Streptococcus pyogenes*, *Streptococcus viridans*, *Treponema pallidum*, *Ureaplasma urealyticum*, *Vibrio cholera*, *Vibrio parahaemolyticus*, *Yersinia pestis*, *Yersinia enterocolitica*, *Yersinia pseudotuberculosis*, *Actinobacter baumanii*, *Pseudomonas aerigunosa*, and a mixture thereof, preferably the bacteria of interest are selected from the group consisting of *Escheri*- chia coli, Enterococcus faecium, Staphylococcus aureus, Klebsiella pneumoniae, Acinetobacter baumanii, Pseudomonas aeruginosa, Enterobacter cloacae, and Enterobacter aerogenes, and a mixture thereof.

In one embodiment, the targeted bacteria are *Escherichia coli*.

Thus, bacteriophages used for preparing the bacterial delivery vehicles, and then the bacterial delivery vehicles, may target (e.g., specifically target) a bacterial cell from any one or more of the foregoing genus and/or species of bacteria to specifically deliver the payload of interest.

In one embodiment, the targeted bacteria are pathogenic bacteria. The targeted bacteria can be virulent bacteria.

The targeted bacteria can be antibacterial resistance bacteria, preferably selected from the group consisting of extended-spectrum beta-lactamase-producing (ESBL) *Escherichia coli*, ESBL *Klebsiella pneumoniae*, vancomycin-resistant *Enterococcus* (VRE), methicillin-resistant *Staphylococcus aureus* (MRSA), multidrug-resistant (MDR) *Acinetobacter baumannii*, MDR *Enterobacter* spp., and a combination thereof. Preferably, the targeted bacteria can be selected from the group consisting of extended-spectrum beta-lactamase-producing (ESBL) *Escherichia coli* strains.

Alternatively, the targeted bacterium can be a bacterium of the microbiome of a given species, preferably a bacterium of the human microbiota.

The present disclosure is directed to bacterial delivery vehicle containing the payload as described herein. The bacterial delivery vehicles are prepared from bacterial virus. The bacterial delivery vehicles are chosen in order to be able to introduce the payload into the targeted bacteria.

Bacterial viruses, from which the bacterial delivery vehicles having chimeric receptor binding proteins and/or branched-RBPs may be derived, are preferably bacteriophages. Optionally, the bacteriophage is selected from the Order Caudovirales consisting of, based on the taxonomy of Krupovic et al, 2015, Arch Virol, 161(1): 233-247:

Bacteriophages may be selected from the family Myoviridae (such as, without limitation, genus Cp220virus, Cp8virus, Ea214virus, Felixo1virus, Mooglevirus, Suspvirus, Hp1virus, P2virus, Kayvirus, P100virus, Silviavirus, Spo1virus, Tsarbombavirus, Twortvirus, Cc31virus, Jd18virus, Js98virus, Kp15virus, Moonvirus, Rb49virus, Rb69virus, S16virus, Schizot4virus, Sp18virus, T4virus, Cr3virus, Se1virus, V5virus, Abouovirus, Agatevirus, Agrican357virus, Ap22virus, Arv1virus, B4virus, Bastillevirus, Bc431virus, Bcep78virus, Bcepmuvirus, Biquartavirus, Bxz1virus, Cd119virus, Cp51virus, Cvm10virus, Eah2virus, Elvirus, Hapunavirus, Jimmervirus, Kpp10virus, M12virus, Machinavirus, Marthavirus, Msw3virus, Muvirus, Myohalovirus, Nit1virus, P1virus, Pakpunavirus, Pbunavirus, Phikzvirus, Rheph4virus, Rsl2virus, Rslunavirus, Secunda5virus, Sep1virus, Spn3virus, Svunavirus, Tg1virus, Vhm1virus and Wphvirus)

Bacteriophages may be selected from the family Podoviridae (such as, without limitation, genus Fri1virus, Kp32virus, Kp34virus, Phikmvvirus, Pradovirus, Sp6virus, T7virus, Cp1 virus, P68virus, Phi29virus, Nona33virus, Pocjvirus, T12011virus, Bcep22virus, Bpp1virus, Cba41virus, Dfl12virus, Ea92virus, Epsilon15virus, F116virus, G7cvirus, Jwalphavirus, Kf1virus, Kpp25virus, Lit1virus, Luz24virus, Luz7virus, N4virus, Nonanavirus, P22virus, Pagevirus, Phieco32virus, Prtbvirus, Sp58virus, Una961virus and Vp5virus)

Bacteriophages may be selected from the family Siphoviridae (such as, without limitation, genus Camvirus, Likavirus, R4virus, Acadianvirus, Coopervirus, Pg1virus, Pipefishvirus, Rosebushvirus, Brujitavirus, Che9cvirus, Hawkeyevirus, Plotvirus, Jerseyvirus, K1gvirus, Sp31virus, Lmd1virus, Una4virus, Bongovirus, Reyvirus, Buttersvirus, Charlievirus, Redivirus, Baxtervirus, Nymphadoravirus, Bignuzvirus, Fishburnevirus, Phayoncevirus, Kp36virus, Roguel virus, Rtpvirus, T1virus, Tlsvirus, Ab18virus, Amigovirus, Anatolevirus, Andromedavirus, Attisvirus, Barnyardvirus, Bernal13virus, Biseptimavirus, Bronvirus, C2virus, C5virus, Cba181virus, Cbastvirus, Cecivirus, Che8virus, Chivirus, Cjw1virus, Corndogvirus, Cronusvirus, D3112virus, D3virus, Decurrovirus, Demosthenesvirus, Doucettevirus, E125virus, Eiauvirus, Ff47virus, Gaiavirus, Gilesvirus, Gordonvirus, Gordtnkvirus, Harrisonvirus, Hk578virus, Hk97virus, Jenstvirus, Jwxvirus, Kelleziovirus, Korravirus, L5virus, lambdavirus, Laroyevirus, Liefievirus, Marvinvirus, Mudcatvirus, N15virus, Nonagvirus, Np1virus, Omegavirus, P12002virus, P12024virus, P23virus, P70virus, Pa6virus, Pamx74virus, Patiencevirus, Pbi1virus, Pepy6virus, Pfr1virus, Phic31virus, Phicbkvirus, Phietavirus, Phifelvirus, Phijl1virus, Pis4avirus, Psavirus, Psimunavirus, Rdj1virus, Rer2virus, Sap6virus, Send513virus, Septima3virus, Seuratvirus, Sextaecvirus, Sfi11virus, Sfi21dt1virus, Sitaravirus, Sk1virus, Slashvirus, Smoothievirus, Soupsvirus, Spbetavirus, Ssp2virus, T5virus, Tankvirus, Tin2virus, Titanvirus, Tm4virus, Tp21virus, Tp84virus, Triavirus, Trigintaduovirus, Vegasvirus, Vendettavirus, Wbetavirus, Wildcatvirus, Wizardvirus, Woesvirus, Xp10virus, Ydn12virus and Yuavirus)

Bacteriophages may be selected from the family Ackermannviridae (such as, without limitation, genus Ag3virus, Limestonevirus, Cba120virus and Vi1virus)

Optionally, the bacteriophage is not part of the order Caudovirales but from families with unassigned order such as, without limitation, family Tectiviridae (such as genus Alphatectivirus, Betatectivirus), family Corticoviridae (such as genus Corticovirus), family Inoviridae (such as genus Fibrovirus, Habenivirus, Inovirus, Lineavirus, Plectrovirus, Saetivirus, Vespertiliovirus), family Cystoviridae (such as genus Cystovirus), family Leviviridae (such as genus Allolevivirus, Levivirus), family Microviridae (such as genus Alpha3microvirus, G4microvirus, Phix174microvirus, Bdellomicrovirus, Chlamydiamicrovirus, Spiromicrovirus) and family Plasmaviridae (such as genus Plasmavirus).

Optionally, the bacteriophage is targeting Archea not part of the Order Caudovirales but from families with Unassigned order such as, without limitation, Ampullaviridae, FuselloViridae, Globuloviridae, Guttaviridae, Lipothrixviridae, Pleolipoviridae, Rudiviridae, Salterprovirus and Bicaudaviridae.

A non-exhaustive listing of bacterial genera and their known host-specific bacteria viruses is presented in the following paragraphs. The chimeric RBPs and/or the branched RBPs and the bacterial delivery vehicles disclosed herein may be engineered, as non-limiting examples, from the following phages. Synonyms and spelling variants are indicated in parentheses. Homonyms are repeated as often as they occur (e.g., D, D, d). Unnamed phages are indicated by "NN" beside their genus and their numbers are given in parentheses.

Bacteria of the genus *Actinomyces* can be infected by the following phages: Av-I, Av-2, Av-3, BF307, CT1, CT2, CT3, CT4, CT6, CT7, CT8 and 1281.

Bacteria of the genus *Aeromonas* can be infected by the following phages: AA-I, Aeh2, N, PM1, TP446, 3, 4, 11, 13, 29, 31, 32, 37, 43, 43-10T, 51, 54, 55R.1, 56, 56RR2, 57, 58, 59.1, 60, 63, Aehl, F, PM2, 1, 25, 31, 40RR2.8t, (syn=44R), (syn=44RR2.8t), 65, PM3, PM4, PM5 and PM6.

Bacteria of the genus *Bacillus* can be infected by the following phages: A, aizl, A1-K-I, B, BCJA1, BC1, BC2, BLL1, BL1, BP142, BSL1, BSL2, BS1, BS3, BS8, BS15, BS18, BS22, BS26, BS28, BS31, BS104, BS105, BS106, BTB, B1715V1, C, CK-I, Coll, Corl, CP-53, CS-I, CSi, D, D, D, D5, entl, FP8, FP9, FSi, FS2, FS3, FS5, FS8, FS9, G, GH8, GT8, GV-I, GV-2, GT-4, g3, g12, g13, g14, g16, g17, g21, g23, g24, g29, H2, ken1, KK-88, Kum1, Kyu1, J7W-1, LP52, (syn=LP-52), L7, Mex1, MJ-I, mor2, MP-7, MP1O, MP12, MP14, MP15, Neo1, N°2, N5, N6P, PBC1, PBLA, PBP1, P2, S-a, SF2, SF6, Sha1, Sil1, SP02, (syn=ΦSPP1), SPβ, STI, STi, SU-Il, t, TbI, Tb2, Tb5, TbIO, Tb26, Tb51, Tb53, Tb55, Tb77, Tb97, Tb99, Tb560, Tb595, Td8, Td6, Tdl5, TgI, Tg4, Tg6, Tg7, Tg9, TgIO, TgIl, Tgl3, Tgl5, Tg21, Tin1, Tin7, Tin8, Tin13, Tm3, Toc1, Tog1, toll, TP-I, TP-10vir, TP-15c, TP-16c, TP-17c, TP-19, TP35, TP51, TP-84, Tt4, Tt6, type A, type B, type C, type D, type E, Tφp3, VA-9, W, wx23, wx26, Yun1, α, γ, pl 1,, φmed-2, φT, φμ-4, φ3T, φ75, φ1O5, (syn=φ1O5), IA, IB, 1-97A, 1-97B, 2, 2, 3, 3, 3, 5, 12, 14, 20, 30, 35, 36, 37, 38, 41C, 51, 63, 64, 138D, I, II, IV, NN-*Bacillus* (13), ale1, AR1, AR2, AR3, AR7, AR9, Bace-11, (syn=11), Bastille, BL1, BL2, BL3, BL4, BL5, BL6, BL8, BL9, BP124, BS28, BS80, Ch, CP-51, CP-54, D-5, dar1, den1, DP-7, ent1, FoSi, FoS2, FS4, FS6, FS7, G, gall, gamma, GE1, GF-2, GSi, GT-I, GT-2, GT-3, GT-4, GT-5, GT-6, GT-7, GV-6, g15, 19, 110, ISi, K, MP9, MP13, MP21, MP23, MP24, MP28, MP29, MP30, MP32, MP34, MP36, MP37, MP39, MP40, MP41, MP43, MP44, MP45, MP47, MP50, NLP-I, No. 1, N17, N19, PBS1, PK1, PMB1, PMB12, PMJ1, S, SPO1, SP3, SP5, SP6, SP7, SP8, SP9, SP1O, SP-15, SP50, (syn=SP-50), SP82, SST, sub1, SW, Tg8, Tgl2, Tgl3, Tgl4, thu1, thuΛ, thuS, Tin4, Tin23, TP-13, TP33, TP50, TSP-I, type V, type VI, V, Vx, β22, φe, φNR2, φ25, φ63, 1, 1, 2, 2C, 3NT, 4, 5, 6, 7, 8, 9, 10, 12, 12, 17, 18, 19, 21, 138, III, 4 (*B. megateriwn*), 4 (*B. sphaericus*), AR13, BPP-IO, BS32, BS107, B1, B2, GA-I, GP-IO, GV-3, GV-5, g8, MP20, MP27, MP49, Nf, PP5, PP6, SF5, Tgl8, TP-I, Versailles, φ15, φ29, 1-97, 837/IV, mï-*Bacillus* (1), BatlO, BSL1O, BSLI1, BS6, BSI1, BS16, BS23, BSI01, BS102, g18, mor1, PBL1, SN45, thu2, thu3, TmI, Tm2, TP-20, TP21, TP52, type F, type G, type IV, HN-BacMus (3), BLE, (syn=θc), BS2, BS4, BS5, BS7, B1O, B12, BS20, BS21, F, MJ-4, PBA12, AP50, AP50-04, AP50-11, AP50-23, AP50-26, AP50-27 and Bam35. The following *Bacillus*-specific phages are defective: DLP10716, DLP-11946, DPB5, DPB12, DPB21, DPB22, DPB23, GA-2, M, No. IM, PBLB, PBSH, PBSV, PBSW, PBSX, PBSY, PBSZ, phi, SPa, type 1 and μ.

Bacteria of the genus *Bacteroides* can be infected by the following phages: ad I2, Baf-44, Baf-48B, Baf-64, Bf-I, Bf-52, B40-8, F1, β1, φA1, φBrO1, φBrO2, 11, 67.1, 67.3, 68.1, mt-*Bacteroides* (3), Bf42, Bf71, HN-*Bdellovibrio* (1) and BF-41.

Bacteria of the genus *Bordetella* can be infected by the following phages: 134 and NN-*Bordetella* (3).

Bacteria of the genus *Borrellia* can be infected by the following phages: NN-*Borrelia* (1) and NN-*Borrelia* (2).

Bacteria of the genus *Brucella* can be infected by the following phages: A422, Bk, (syn=Berkeley), BM29, FOi, (syn=FO1), (syn=FQ1), D, FP2, (syn=FD2), Fz, (syn=Fz75/13), (syn=Firenze 75/13), (syn=Fi), Fi, (syn=F1), Fim, (syn=FIm), (syn=Fim), FiU, (syn=F1U), (syn=FiU), F2, (syn=F2), F3, (syn=F3), F4, (syn=F4), F5, (syn=F5), F6, F7, (syn=F7), F25, (syn=F25), (syn=£25), F25U, (syn=F25u), (syn=F25U), (syn=F25V), F44, (syn=F44), F45, (syn=F45), F48, (syn=F48), I, Im, M, MC/75, M51, (syn=M85), P, (syn=D), S708, R, Tb, (syn=TB), (syn=Tbilisi), W, (syn=Wb), (syn=Weybridge), X, 3, 6, 7, 10/1, (syn=10), (syn=F8), (syn=F8), 12m, 24/11, (syn=24), (syn=F9), (syn=F9), 45/111, (syn=45), 75, 84, 212/XV, (syn=212), (syn=Fi0), (syn=F1O), 371/XXIX, (syn=371), (syn=Fn), (syn=F11) and 513.

Bacteria of the genus *Burkholderia* can be infected by the following phages: CP75, NN-*Burkholderia* (1) and 42.

Bacteria of the genus *Campylobacter* can be infected by the following phages: C type, NTCC12669, NTCC12670, NTCC12671, NTCC12672, NTCC12673, NTCC12674, NTCC12675, NTCC12676, NTCC12677, NTCC12678, NTCC12679, NTCC12680, NTCC12681, NTCC12682, NTCC12683, NTCC12684, 32f, 11c, 191, NN-*Campylobacter* (2), Vfi-6, (syn=V19), VfV-3, V2, V3, V8, V16, (syn=Vfi-1), V19, V20(V45), V45, (syn=V-45) and NN-*Campylobacter* (1).

Bacteria of the genus *Chlamydia* can be infected by the following phage: Chp1.

Bacteria of the genus *Clostridium* can be infected by the following phages: CAK1, CA5, Ca7, CEPβ, (syn=1C), CEγ, Cld1, c-n71, c-203 Tox–, DEPβ, (syn=ID), (syn=1Dt0X+), HM3, KM1, KT, Ms, NA1, (syn=Naltox+), PA135Oe, Pfó, PL73, PL78, PL81, P1, P50, P5771, P19402, 1CtOX+, 2CtOX\2D3 (syn=2Dt0X+), 3C, (syn=3Ctox+), 4C, (syn=4CtOX+), 56, III-1, NN-*Clostridium* (61), NB1t0X+, α1, CA1, HMT, HM2, PF15 P-23, P-46, Q-05, Q-oe, Q-16, Q-21, Q-26, Q-40, Q-46, S111, SA02, WA01, WA03, Wm, W523, 80, C, CA2, CA3, CPT1, CPT4, c1, c4, c5, HM7, H11/A1, H18/Ax, FWS23, Hi58ZA1, K2ZA1, K21ZS23, ML, NA2t0X; Pf2, Pf3, Pf4, S9ZS3, S41ZA1, S44ZS23, α2, 41, 112ZS23, 214/S23, 233/Ai, 234/S23, 235/S23, II-1, 11-2, 11-3, NN-*Clostridium* (12), CA1, F1, K, S2, 1, 5 and NN-*Clostridium* (8).

Bacteria of the genus *Corynebacterium* can be infected by the following phages: CGK1 (defective), A, A2, A3, A1O1, A128, A133, A137, A139, A155, A182, B, BF, B17, B18, B51, B271, B275, B276, B277, B279, B282, C, capi, CC1, CG1, CG2, CG33, CL31, Cog, (syn=CG5), D, E, F, H, H-I, hqi, hq2, 11ZH33, Ii/31, J, K, K, (syn=Ktox"), L, L, (syn=Ltox+), M, MC-I, MC-2, MC-3, MC-4, MLMa, N, O, ovi, ov2, ov3, P, P, R, RP6, RS29, S, T, U, UB1, ub2, UH1, UH3, uh3, uh5, uh6, β, (syn=βtox+), βhv64, βvir, γ, (syn=γtoχ–), γ19, δ, (syn=δ'ox+), ρ, (syn=ptoχ–), Φ9, φ984, ω, IA, 1/1180, 2, 2/1180, 5/1180, 5ad/9717, 7/4465, 8/4465, 8ad/10269, 10/9253, 13Z9253, 15/3148, 21/9253, 28, 29, 55, 2747, 2893, 4498 and 5848.

Bacteria of the genus *Enterococcus* can be infected by the following phages: DF78, F1, F2, 1, 2, 4, 14, 41, 867, D1, SB24, 2BV, 182, 225, C2, C2F, E3, E62, DS96, H24, M35, P3, P9, SB1O1, S2, 2BII, 5, 182a, 705, 873, 881, 940, 1051, 1057, 21096C, NN-*Enterococcus* (1), PE1, F1, F3, F4, VD13, 1, 200, 235 and 341.

Bacteria of the genus *Erysipelothrix* can be infected by the following phage: NN-Eiysipelothrix (1).

Bacteria of the genus *Escherichia* can be infected by the following phages: BW73, B278, D6, D108, E, E1, E24, E41, FI-2, FI-4, FI-5, HI8A, Ffl8B, i, MM, Mu, (syn=mu), (syn=Mul), (syn=Mu-I), (syn=MU-I), (syn=MuI), (syn=μ), 025, Ph-5, Pk, PSP3, P1, P1D, P2, P4 (defective), S1, Wφ, φK13, φR73 (defective), φ1, φ2, φ7, φ92, ψ (defective), 7 A, 8φ, 9φ, 15 (defective), 18, 28-1, 186, 299, HH-*Escheri*-

*chia* (2), AB48, CM, C4, C16, DD-VI, (syn=Dd-Vi), (syn=DDVI), (syn=DDVi), E4, E7, E28, FI1, FI3, H, H1, H3, H8, K3, M, N, ND-2, ND-3, ND4, ND-5, ND6, ND-7, Ox-I (syn=OX1), (syn=HF), Ox-2 (syn=0x2), (syn=0X2), Ox-3, Ox-4, Ox-5, (syn=0X5), Ox-6, (syn=66F), (syn=φ66t), (syn=φ66t-)5 0111, Ph-I, RB42, RB43, RB49, RB69, S, Sal-I, Sal-2, Sal-3, Sal-4, Sal-5, Sal-6, TC23, TC45, TuII*-6, (syn=TuII*), TuIP-24, TuII*46, TuIP-60, T2, (syn=ganuTia), (syn=γ), (syn=PC), (syn=P.C.), (syn=T-2), (syn=T2), (syn=P4), T4, (syn=T-4), (syn=T4), T6, T35, α1, 1, IA, 3, (syn=Ac3), 3A, 3T+, (syn=3), (syn=M1), 5φ, (syn=φ5), 9266Q, CFO103, HK620, J, K, K1F, m59, no. A, no. E, no. 3, no. 9, N4, sd, (syn=Sd), (syn=SD), (syn=Sa)3 (syn=sd), (syn=SD), (syn=CD), T3, (syn=T-3), (syn=T3), T7, (syn=T-7), (syn=T7), WPK, W31, ΔH, φC3888, φK3, φK7, φK12, φV-1, Φ04-CF, Φ05, Φ06, Φ07, φ1, φ1.2, φ20, φ95, φ263, φ1O92, φ1, φ11, (syn=φW), Ω8, 1, 3, 7, 8, 26, 27, 28-2, 29, 30, 31, 32, 38, 39, 42, 933W, NN-*Escherichia* (1), Esc-7-11, AC30, CVX-5, C1, DDUP, EC1, EC2, E21, E29, F1, F26S, F27S, Hi, HK022, HK97, (syn=ΦHK97), HK139, HK253, HK256, K7, ND-I, no. D, PA-2, q, S2, T1, (syn=α), (syn=P28), (syn=T-I), (syn=Tx), T3C, T5, (syn=T-5), (syn=T5), UC-I, w, β4, γ2, λ(syn=lambda), (syn=Φλ), ΦD326, φγ, Φ06, φ7, Φ10, φ80, χ, (syn=χi), (syn=φχ), (syn=φχi), 2, 4, 4A, 6, 8A, 102, 150, 168, 174, 3000, AC6, AC7, AC28, AC43, AC50, AC57, AC81, AC95, HK243, K1O, ZG/3A, 5, 5A, 21EL, H19-J and 933H.

Bacteria of the genus *Fusobacterium* can be infected by the following phages: NN-*Fusobacterium* (2), fv83-554/3, fv88-531/2, 227, fv2377, fv2527 and fv8501.

Bacteria of the genus *Haemophilus* can be infected by the following phages: HP1, S2 and N3.

Bacteria of the genus *Helicobacter* can be infected by the following phages: HP1 and ˆˆ-*Helicobacter* (1).

Bacteria of the genus *Klebsiella* can be infected by the following phages: AIO-2, KI4B, K16B, K19, (syn=K19), K114, K115, K121, K128, K129, K132, K133, K135, Kl106B, Kl171B, Kl181B, K1832B, AIO-I, AO-I, AO-2, AO-3, FC3-10, K, Kl1, (syn=KI1), Kl12, (syn=K12), Kl3, (syn=K13), (syn=Kl 70/11), Kl4, (syn=K14), Kl5, (syn=K15), Kl6, (syn=K16), Kl7, (syn=K17), Kl8, (syn=K18), Kl19, (syn=K19), Kl27, (syn=K127), Kl31, (syn=K131), Kl35, Kl171B, II, VI, IX, CI-I, K14B, Kl8, Kl11, Kl12, Kl13, Kl16, Kl17, Kl18, Kl20, Kl22, Kl23, Kl24, Kl26, Kl30, Kl34, Kl106B, KIi65B, Kl328B, KLXI, K328, P5046, 11, 380, III, IV, VII, VIII, FC3-11, Kl2B, (syn=K12B), Kl25, (syn=K125), Kl42B, (syn=K142), (syn=K142B), Kl181B, (syn=KI1 81), (syn=K1181B), Kl1765/!, (syn=K1765/1), Kl842B, (syn=K1832B), Kl937B, (syn=K1937B), L1, φ28, 7, 231, 483, 490, 632 and 864/100.

Bacteria of the genus *Lepitospira* can be infected by the following phages: LE1, LE3, LE4 and ~NN-*Leptospira* (1).

Bacteria of the genus *Listeria* can be infected by the following phages: A511, 01761, 4211, 4286, (syn=BO54), A005, A006, A020, A500, A502, A511, A1 18, A620, A640, B012, B021, B024, B025, B035, B051, B053, B054, B055, B056, B1O1, BI 10, B545, B604, B653, C707, D441, HSO47, H1OG, H8/73, H19, H21, H43, H46, H107, H108, HI 10, H163/84, H312, H340, H387, H391/73, H684/74, H924A, PSA, U153, φMLUP5, (syn=P35), 00241, 00611, 02971A, 02971C, 5/476, 5/911, 5/939, 5/11302, 5/11605, 5/11704, 184, 575, 633, 699/694, 744, 900, 1090, 1317, 1444, 1652, 1806, 1807, 1921/959, 1921/11367, 1921/11500, 1921/11566, 1921/12460, 1921/12582, 1967, 2389, 2425, 2671, 2685, 3274, 3550, 3551, 3552, 4276, 4277, 4292, 4477, 5337, 5348/11363, 5348/11646, 5348/12430, 5348/12434, 10072, 11355C, 11711A, 12029, 12981, 13441, 90666, 90816, 93253, 907515, 910716 and NN-Lisferia (15).

Bacteria of the genus *Morganella* can be infected by the following phage: 47.

Bacteria of the genus *Mycobacterium* can be infected by the following phages: 13, AG1, ALi, ATCC 11759, A2, B.C3, BG2, BK1, BK5, *butyricum*, B-I, B5, B7, B30, B35, Clark, C1, C2, DNAIII, DSP1, D4, D29, GS4E, (syn=GS4E), GS7, (syn=GS-7), (syn=GS7), IPa, lacticola, Legendre, Leo, L5, (syn=ΦL-5), MC-I, MC-3, MC-4, minetti, MTPHI 1, Mx4, MyF3P/59a, *phlei*, (syn=*phlei* 1), *phlei* 4, Polonus II, rabinovitschi, *smegmatis*, TM4, TM9, TM1O, TM20, Y7, Y1O, φ630, IB, IF, IH, 1/1, 67, 106, 1430, B1, (syn=Bol), B24, D, D29, F-K, F-S, HP, Polonus I, Roy, R1, (syn=R1-Myb), (syn=Ri), 11, 31, 40, 50, 103a, 103b, 128, 3111-D, 3215-D and NN-*Mycobacterium* (1).

Bacteria of the genus *Neisseria* can be infected by the following phages: Group I, group II and NP1.

Bacteria of the genus *Nocardia* can be infected by the following phages: MNP8, NJ-L, NS-8, N5 and TtiN-*Nocardia*.

Bacteria of the genus *Proteus* can be infected by the following phages: Pm5, 13vir, 2/44, 4/545, 6/1004, 13/807, 20/826, 57, 67b, 78, 107/69, 121, 9/0, 22/608, 30/680, PmI, Pm3, Pm4, Pm6, Pm7, Pm9, PmIO, PmI 1, Pv2, π1, φm, 7/549, 9B/2, 10A/31, 12/55, 14, 15, 16/789, 17/971, 19A/653, 23/532, 25/909, 26/219, 27/953, 32A/909, 33/971, 34/13, 65, 5006M, 7480b, VI, 13/3a, Clichy 12, π2600, φχ7, 1/1004, 5/742, 9, 12, 14, 22, 24/860, 2600/D52, Pm8 and 24/2514.

Bacteria of the genus *Providencia* can be infected by the following phages: PL25, PL26, PL37, 9211/9295, 9213/921 Ib, 9248, 7/R49, 7476/322, 7478/325, 7479, 7480, 9000/9402 and 9213/921 Ia.

Bacteria of the genus *Pseudomonas* can be infected by the following phages: PfI, (syn=Pf-I), Pf2, Pf3, PP7, PRR1, 7s, im-*Pseudomonas* (1), AI-I, AI-2, B 17, B89, CB3, Col 2, Col 11, Col 18, Col 21, C154, C163, C167, C2121, E79, F8, ga, gb, H22, K1, M4, N2, Nu, PB-I, (syn=PB1), pfl6, PMN17, PP1, PP8, Psa1, PsP1, PsP2, PsP3, PsP4, PsP5, PS3, PS17, PTB80, PX4, PX7, PYO1, PYO2, PYO5, PYO6, PYO9, PYO1O, PYO13, PYO14, PYO16, PYO18, PYO19, PYO20, PYO29, PYO32, PYO33, PYO35, PYO36, PYO37, PYO38, PYO39, PYO41, PYO42, PYO45, PYO47, PYO48, PYO64, PYO69, PYO103, P1K, SLP1, SL2, S2, UNL-I, wy, Yai, Ya4, Yan, φBE, φCTX, φC17, φKZ, (syn=ΦKZ), Φ-LT, Φmu78, φNZ, φPLS-1, φST-1, φW-14, φ-2, 1/72, 2/79, 3, 3/DO, 4/237, 5/406, 6C, 6/6660, 7, 7v, 7/184, 8/280, 9/95, 10/502, 11/DE, 12/100, 12S, 16, 21, 24, 25F, 27, 31, 44, 68, 71, 95, 109, 188, 337, 352, 1214, HN-*Pseudomonas* (23), A856, B26, CI-I, CI-2, C5, D, gh-1, F1 16, HF, H90, K5, K6, K1 04, K109, K166, K267, N4, N5, O6N-25P, PE69, Pf, PPN25, PPN35, PPN89, PPN91, PP2, PP3, PP4, PP6, PP7, PP8, PP56, PP87, PP1 14, PP206, PP207, PP306, PP651, Psp231a, Pssy401, Pssy9220, psi, PTB2, PTB20, PTB42, PX1, PX3, PX1O, PX12, PX14, PYO70, PYO71, R, SH6, SH133, tf, Ya5, Ya7, φBS, ΦKf77, φ-MC, ΦmnF82, φPLS27, φPLS743, φS-1, 1, 2, 3, 4, 5, 6, 7, 7, 8, 9, 10, 11, 12, 12B, 13, 14, 15, 14, 15, 16, 17, 18, 19, 20, 20, 21, 21, 22, 23, 23, 24, 25, 31, 53, 73, 119x, 145, 147, 170, 267, 284, 308, 525, NN-*Pseudomonas* (5), af, A7, B3, B33, B39, BI-I, C22, D3, D37, D40, D62, D3112, F7, F1O, g, gd, ge, gξHwl2, Jb 19, KF, L°, OXN-32P, O6N-52P, PCH-I, PC13-1, PC35-1, PH2, PH51, PH93, PH132, PMW, PM13, PM57, PM61, PM62, PM63, PM69, PM105, PM1 13, PM681, PM682, PO4, PP1, PP4, PP5, PP64, PP65, PP66, PP71, PP86, PP88, PP92, PP401, PP711, PP891, Pssy41, Pssy42, Pssy403, Pssy404, Pssy420, Pssy923, PS4, PS-IO, Pz, SD1, SL1, SL3, SL5, SM, φC5, φCl 1, φCl 1-1, φC13, φC15, φMO, φX, φO4, φ1 1, φ240, 2, 2F, 5, 7m, 11, 13, 13/441, 14, 20, 24, 40, 45, 49, 61, 73, 148, 160, 198, 218, 222, 236, 242, 246, 249, 258, 269, 295, 297, 309, 318, 342, 350, 351, 357-1, 400-1, HN-*Pseudomonas* (6), G1O1, M6, M6a, L1, PB2, Pssyl5, Pssy4210, Pssy4220, PYO12, PYO34, PYO49, PYO50, PYO51, PYO52, PYO53, PYO57, PYO59, PYO200, PX2, PX5, SL4, φO3, φO6 and 1214.

Bacteria of the genus *Rickettsia* can be infected by the following phage: NN-*Rickettsia*.

Bacteria of the genus *Salmonella* can be infected by the following phages: b, Beccles, CT, d, Dundee, f, FeIs 2, GI, GUI, GVI, GVIII, k, K, i, j, L, 01, (syn=0-1), (syn=O1), (syn=O-I), (syn=7), 02, 03, P3, P9a, P1O, Sab3, Sab5, San1S, San17, SI, Taunton, ViI, (syn=ViI), 9, imSalmonella (1), N-I, N-5, N-IO, N-17, N-22, 11, 12, 16-19, 20.2, 36, 449C/C178, 966A/C259, a, B.A.O.R., e, G4, GUI, L, LP7, M, MG40, N-18, PSA68, P4, P9c, P22, (syn=P22), (syn=PLT22), (syn=PLT22), P22al, P22-4, P22-7, P22-11, SNT-I, SNT-2, SP6, Villi, ViIV, ViV, ViVI, ViVII, Worksop, Sj5, ε34, 1, 37, 1(40), (syn=φ1[40]), 1, 422, 2, 2.5, 3b, 4, 5, 6, 14(18), 8, 14(6,7), 10, 27, 28B, 30, 31, 32, 33, 34, 36, 37, 39, 1412, SNT-3, 7-11, 40.3, c, C236, C557, C625, C966N, g, GV, G5, G1 73, h, IRA, Jersey, MB78, P22-1, P22-3, P22-12, Sab1, Sab2, Sab2, Sab4, San1, San2, San3, San4, San6, San7, San8, San9, San13, San14, San16, San18, San19, San20, San21, San22, San23, San24, San25, San26, SasL1, SasL2, SasL3, SasL4, SasL5, S1BL, SII, ViII, φ1, 1, 2, 3a, 3al, 1010, Ym-*Salmonella* (1), N-4, SasL6 and 27.

Bacteria of the genus *Serratia* can be infected by the following phages: A2P, PS20, SMB3, SMP, SMP5, SM2, V40, V56, ic, ΦCP-3, ΦCP-6, 3M, 10/la, 20A, 34CC, 34H, 38T, 345G, 345P, 501B, SMB2, SMP2, BC, BT, CW2, CW3, CW4, CW5, Lt232, L2232, L34, L.228, SLP, SMPA, V.43, σ, φCW1, ΦCP6-1, ΦCP6-2, ΦCP6-5, 3T, 5, 8, 9F, 10/1, 20E, 32/6, 34B, 34CT, 34P, 37, 41, 56, 56D, 56P, 60P, 61/6, 74/6, 76/4, 101/8900, 226, 227, 228, 229F, 286, 289, 290F, 512, 764a, 2847/10, 2847/10a, L.359 and SMB1.

Bacteria of the genus *Shigella* can be infected by the following phages: Fsa, (syn=a), FSD2d, (syn=D2d), (syn=W2d), FSD2E, (syn=W2e), fv, F6, f7.8, H-Sh, PE5, P90, SfII, Sh, SHm, SHrv, (syn=HIV), SHvi, (syn=HVI), SHVvm, (syn=HVIII), SKγ66, (syn=gamma 66), (syn=γββ), (syn=γ66b), SKm, (syn=SIIIb)5 (syn=UI), SKw, (syn=Siva), (syn=IV), SIC™, (syn=SIVA.), (syn=IVA), SKvi, (syn=KVI), (syn=Svi), (syn=VI), SKvm, (syn=Svm), (syn=VIII), SKVHIA, (syn=SvmA), (syn=VIIIA), STvi, STK, STx1, STxn, S66, W2, (syn=D2c), (syn=D20), φ1, φIVb 3-SO-R, 8368-SO-R, F7, (syn=FS7), (syn=K29), F1O, (syn=FS1O), (syn=K31), I1, (syn=alfa), (syn=FSa), (syn=K1 8), (syn=α), I2, (syn=a), (syn=K19), SG33, (syn=G35), (syn=SO-35/G), SG35, (syn=SO-55/G), SG3201, (syn=SO-3201/G), SHn, (syn=HII), SHv, (syn=SHV), SHx, SHX, SKn, (syn=K2), (syn=KII), (syn=Sn), (syn=SsII), (syn=II), SKrv, (syn=Sm), (syn=SsIV), (syn=IV), SK1Va, (syn=Swab), (syn=SsIVa), (syn=IVa), SKV, (syn=K4), (syn=KV), (syn=SV), (syn=SsV), (syn=V), SKx, (syn=K9), (syn=KX), (syn=SX), (syn=SsX), (syn=X), STV, (syn=T35), (syn=35-50-R), STvm, (syn=T8345), (syn=8345-SO—S-R), W1, (syn=D8), (syn=FSD8), W2a, (syn=D2A), (syn=FS2a), DD-2, Sf6, FSi, (syn=F1), SF6, (syn=F6), SG42, (syn=SO-42/G), SG3203, (syn=SO-3203/G), SKF12, (syn=SsF12), (syn=F12), STn, (syn=1881-SO-R), γ66, (syn=gamma 66a), (syn=Ssγ66), φ2, BI1, DDVII, (syn=DD7), FSD2b, (syn=W2B), FS2, (syn=F2), (syn=F2), FS4, (syn=F4), (syn=F4), FS5, (syn=F5), (syn=F5), FS9, (syn=F9), (syn=F9), FI 1, P2-SO-S, SG36, (syn=SO-36/G), (syn=G36), SG3204, (syn=SO-3204/G), SG3244, (syn=SO-3244/G), SHi, (syn=HI), SHvπ, (syn=HVII), SHK, (syn=HIX), SHx1, SHxπ, (syn=HXn), SKI, KI, (syn=S1), (syn=SsI), SKVII, (syn=KVII), (syn=Svπ), (syn=SsVII), SKIX, (syn=KIX), (syn=S1x), (syn=SsIX), SKXII, (syn=KXII), (syn=Sxn), (syn=SsXII), STi, STff1, STrv, STVi, STvπ, S70, S206, U2-S0-S, 3210-SO-S, 3859-SO-S, 4020-SO-S, φ3, φ5, φ7, φ8, φ9, φ1O, φ1 1, φ13, φ14, φ18, SHm, (syn=Hπi), SHχi, (syn=HXt) and SKxI, (syn=KXI), (syn=Sχi), (syn=SsXI), (syn=XI).

Bacteria of the genus *Staphylococcus* can be infected by the following phages: A, EW, K, Ph5, Ph9, PhIO, Ph13, P1, P2, P3, P4, P8, P9, P1O, RG, SB-i, (syn=Sb-I), S3K, Twort, ΦSK311, φ812, 06, 40, 58, 119, 130, 131, 200, 1623, STC1, (syn=stcl), STC2, (syn=stc2), 44AHJD, 68, AC1, AC2, A6"C", A9"C", b581, CA-I, CA-2, CA-3, CA-4, CA-5, DI 1, L39x35, L54a, M42, N1, N2, N3, N4, N5, N7, N8, N1O, Ni 1, N12, N13, N14, N16, Ph6, Phl2, Phl4, UC-18, U4, U15, S1, S2, S3, S4, S5, X2, Z1, φB5-2, φD, ω, 11, (syn=φ1 1), (syn=P11-M15), 15, 28, 28A, 29, 31, 31B, 37, 42D, (syn=P42D), 44A, 48, 51, 52, 52A, (syn=P52A), 52B, 53, 55, 69, 71, (syn=P71), 71A, 72, 75, 76, 77, 79, 80, 80a, 82, 82A, 83 A, 84, 85, 86, 88, 88A, 89, 90, 92, 95, 96, 102, 107, 108, 111, 129-26, 130, 130A, 155, 157, 157A, 165, 187, 275, 275A, 275B, 356, 456, 459, 471, 471A, 489, 581, 676, 898, 1139, 1154A, 1259, 1314, 1380, 1405, 1563, 2148, 2638A, 2638B, 2638C, 2731, 2792A, 2792B, 2818, 2835, 2848A, 3619, 5841, 12100, AC3, A8, A1O, A13, b594n, D, HK2, N9, N15, P52, P87, S1, S6, Z4, φRE, 3A, 3B, 3C, 6, 7, 16, 21, 42B, 42C, 42E, 44, 47, 47A5 47C, 51, 54, 54×1, 70, 73, 75, 78, 81, 82, 88, 93, 94, 101, 105, 110, 115, 129/16, 174, 594n, 1363/14, 2460 and mS-*Staphylococcus* (1).

Bacteria of the genus *Streptococcus* can be infected by the following phages: EJ-I, NN-Streptococais (1), a, C1, FL0Ths, H39, Cp-I, Cp-5, Cp-7, Cp-9, Cp-IO, AT298, A5, a1O/J1, a1O/J2, a1O/J5, a1O/J9, A25, BTI 1, b6, CA1, c20-1, c20-2, DP-I, Dp-4, DT1, ET42, e1O, FA101, FEThs, Fκ, FKKIOI, FKLIO, FKP74, FKH, FLOThs, FyIOl, f1, F10, F20140/76, g, GT-234, HB3, (syn=HB-3), HB-623, HB-746, M102, O1205, φO1205, PST, PO, P1, P2, P3, P5, P6, P8, P9, P9, P12, P13, P14, P49, P50, P51, P52, P53, P54, P55, P56, P57, P58, P59, P64, P67, P69, P71, P73, P75, P76, P77, P82, P83, P88, sc, sch, sf, SfIl 1, (syn=SFiI 1), (syn=φSFi11), (syn=ΦSfil 1), (syn=φSfil 1), sfil9, (syn=SFil9), (syn=φSFil9), (syn=φSfil9), Sfi21, (syn=SFi21), (syn=φSFi21), (syn=φSfi21), ST0, STX, st2, ST2, ST4, S3, (syn=φS3), s265, Φ17, φ42, Φ57, φ80, φ81, φ982, φ983, φ984, φ985, φ986, φ987, φ988, φ989, φ90, φ91, φ992, φ993, φ994, φ995, φ996, φ97, φ98, φ99, φ1OO, φ1O1, φ1O2, φ227, Φ7201, ω1, ω2, ω3, ω4, ω5, ω6, ω8, ω1O, 1, 6, 9, 1OF, 12/12, 14, 17SR, 19S, 24, 50/33, 50/34, 55/14, 55/15, 70/35, 70/36, 71/ST15, 71/45, 71/46, 74F, 79/37, 79/38, 80/J4, 80/J9, 80/ST16, 80/15, 80/47, 80/48, 101, 103/39, 103/40, 121/41, 121/42, 123/43, 123/44, 124/44, 337/ST17 and mStreptococcus (34).

Bacteria of the genus *Treponema* can be infected by the following phage: NN-*Treponema* (1).

Bacteria of the genus *Vibrio* can be infected by the following phages: CTXΦ, fs, (syn=si), fs2, Ivpf5, Vfl2, Vf33, VPIΦ, VSK, v6, 493, CP-T1, ET25, kappa, K139, Labol,) XN-69P, OXN-86, O6N-21P, PB-I, P147, rp-1, SE3, VA-I, (syn=VcA-I), VcA-2, VP1, VP2, VP4, VP7, VP8, VP9, VP1O, VP17, VP18, VP19, X29, (syn=29 d'Herelle), t, ΦHAWI-1, ΦHAWI-2, ΦHAWI-3, ΦHAWI-4, ΦHAWI-5, ΦHAWI-6, ΦHAWI-7, ΦHAWI-8, ΦHAWI-9, ΦHAWI-10, ΦHC1-1, ΦHC1-2, ΦHC1-3, ΦHC1-4, ΦHC2-1, >HC2-2, ΦHC2-3, ΦHC2-4, ΦHC3-1, ΦHC3-2, φHC3-3, ΦHD1S-1, ΦHD1S-2, ΦHD2S-1, ΦHD2S-2, ΦHD2S-3, ΦHD2S-4, ΦHD2S-5, ΦHDO-1, ΦHDO-2, ΦHDO-3, ΦHDO-4, ΦHDO-5, ΦHDO-6, ΦKL-33, ΦKL-34, ΦKL-35, ΦKL-36, ΦKWH-2, ΦKWH-3, ΦKWH-4, ΦMARQ-1, ΦMARQ-2, ΦMARQ-3, ΦMOAT-1, ΦO139, ΦPEL1A-1, ΦPEL1A-2, ΦPEL8A-1, ΦPEL8A-2, ΦPEL8A-3, ΦPEL8C-1, ΦPEL8C-2, ΦPEL13A-1, ΦPEL13B-1, ΦPEL13B-2, ΦPEL13B-3, ΦPEL13B-4, ΦPEL13B-5, ΦPEL13B-6, ΦPEL13B-7, ΦPEL13B-8, ΦPEL13B-9, ΦPEL13B-10, φVP143, φVP253, Φ16, φ138, 1-II, 5, 13, 14, 16, 24, 32, 493, 6214, 7050, 7227, II, (syn=group II), (syn=φ2), V, VIII, ~m-*Vibrio* (13), KVP20, KVP40, nt-1, O6N-22P, P68, e1, e2, e3, e4, e5, FK, G, I, K, nt-6, N1, N2, N3, N4, N5, O6N-34P, OXN-72P, OXN-85P, OXN-100P, P, Ph-I, PL163/10, Q, S, T, φ92, 1-9, 37, 51, 57, 70A-8, 72A-4, 72A-10, 110A-4, 333, 4996, I (syn=group I), III (syn=group III), VI, (syn=A-Saratov), VII, IX, X, HN-*Vibrio* (6), pA1, 7, 7-8, 70A-2, 71A-6, 72A-5, 72A-8, 108A-10, 109A-6, 109A-8, 11OA-1, 110A-5, 110A-7, hv-1, OXN-52P, P13, P38, P53, P65, P108, Pill, TP13 VP3, VP6, VP12, VP13, 70A-3, 70A-4, 70A-10, 72A-1, 108A-3, 109-B1, 110A-2, 149, (syn=φ149), IV, (syn=group IV), NN-*Vibrio* (22), VP5, VPI1, VP15, VP16, α1, α2, α3a, α3b, 353B and HN-*Vibrio* (7).

Bacteria of the genus *Yersinia* can be infected by the following phages: H, H-1, H-2, H-3, H-4, Lucas 110, Lucas 303, Lucas 404, YerA3, YerA7, YerA20, YerA41, 3/M64-76, 5/G394-76, 6/C753-76, 8/C239-76, 9/F18167, 1701, 1710, PST, 1/F2852-76, D'Herelle, EV, H, Kotljarova, PTB, R, Y, YerA41, φYerO3-12, 3, 4/C1324-76, 7/F783-76, 903, 1/M6176 and Yer2AT.

More preferably, the bacteriophage is selected in the group consisting of *Salmonella* virus SKML39, *Shigella* virus AG3, Dickeya virus Limestone, Dickeya virus RC2014, *Escherichia* virus CBA120, *Escherichia* virus PhaxI, *Salmonella* virus 38, *Salmonella* virus Det7, *Salmonella* virus GG32, *Salmonella* virus PM10, *Salmonella* virus SFP10, *Salmonella* virus SH19, *Salmonella* virus SJ3, *Escherichia* virus ECML4, *Salmonella* virus Marshall, *Salmonella* virus Maynard, *Salmonella* virus SJ2, *Salmonella* virus STML131, *Salmonella* virus Vil, *Erwinia* virus Ea2809, *Klebsiella* virus 0507KN21, *Serratia* virus IME250, *Serratia* virus MAM1, *Campylobacter* virus CP21, *Campylobacter* virus CP220, *Campylobacter* virus CPt10, *Campylobacter* virus IBB35, *Campylobacter* virus CP81, *Campylobacter* virus CP30A, *Campylobacter* virus CPX, *Campylobacter* virus NCTC12673, *Erwinia* virus Ea214, *Erwinia* virus M7, *Escherichia* virus AYO145A, *Escherichia* virus EC6, *Escherichia* virus HY02, *Escherichia* virus JH2, *Escherichia* virus TP1, *Escherichia* virus VpaE1, *Escherichia* virus wV8, *Salmonella* virus FelixO1, *Salmonella* virus HB2014, *Salmonella* virus Mushroom, *Salmonella* virus UAB87, *Citrobacter* virus Moogle, *Citrobacter* virus Mordin, *Escherichia* virus SUSP1, *Escherichia* virus SUSP2, *Aeromonas* virus phiO18P, *Haemophilus* virus HP1, *Haemophilus* virus HP2, *Pasteurella* virus F108, *Vibrio* virus K139, *Vibrio* virus Kappa, *Burkholderia* virus phi52237, *Burkholderia* virus phiE122, *Burkholderia* virus phiE202, *Escherichia* virus 186, *Escherichia* virus P4, *Escherichia* virus P2, *Escherichia* virus Wphi, Mannheimia virus PHL101, *Pseudomonas* virus phiCTX, *Ralstonia* virus RSA1, *Salmonella* virus Fels2, *Salmonella* virus PsP3, *Salmonella* virus SopEphi, *Yersinia* virus L413C, *Staphylococcus* virus G1, *Staphylococcus* virus G15, *Staphylococcus* virus JD7, *Staphylococcus* virus K, *Staphylococcus* virus MCE2014, *Staphylococcus* virus P108, *Staphylococcus* virus Rodi, *Staphylococcus* virus S253, *Staphylococcus* virus S25-4, *Staphylococcus* virus SA12, *Listeria* virus A511, *Listeria* virus P100, *Staphylococcus* virus Remus, *Staphylococcus* virus SA11, *Staphylococcus* virus Stau2, *Bacillus* virus Camphawk, *Bacillus* virus SPO1, *Bacillus* virus BCP78, *Bacillus* virus TsarBomba, *Staphylococcus* virus Twort, *Enterococcus* virus phiEC24C, *Lactobacillus* virus Lb338-1, *Lactobacillus* virus LP65, *Enterobacter* virus PG7, *Escherichia* virus CC31, *Klebsiella* virus JD18, *Klebsiella* virus PKO111, *Escherichia* virus Bp7, *Escherichia* virus IME08, *Escherichia* virus JS 10, *Escherichia* virus JS98, *Escherichia* virus QL01, *Escherichia* virus VR5, *Enterobacter* virus Eap3, *Klebsiella* virus KP15, *Klebsiella* virus KP27, *Klebsiella* virus Matisse, *Klebsiella* virus Miro, *Citrobacter* virus Merlin, *Citrobacter* virus Moon, *Escherichia* virus JSE, *Escherichia* virus phi1, *Escherichia* virus RB49, *Escherichia* virus HX01, *Escherichia* virus JS09, *Escherichia* virus RB69, *Shigella* virus UTAM, *Salmonella* virus S16, *Salmonella* virus STML198, *Vibrio* virus KVP40, *Vibrio* virus nt1, *Vibrio* virus ValKK3, *Escherichia* virus VR7, *Escherichia* virus VR20, *Escherichia* virus VR25, *Escherichia* virus VR26, *Shigella* virus SP18, *Escherichia* virus AR1, *Escherichia* virus C40, *Escherichia* virus E112, *Escherichia* virus ECML134, *Escherichia* virus HY01, *Escherichia* virus Ime09, *Escherichia* virus RB3, *Escherichia* virus RB14, *Escherichia* virus T4, *Shigella* virus Pss1, *Shigella* virus Shfl2, *Yersinia* virus D1, *Yersinia* virus PST, *Acinetobacter* virus 133, *Aeromonas* virus 65, *Aeromonas* virus Aehl, *Escherichia* virus RB16, *Escherichia* virus RB32, *Escherichia* virus RB43, *Pseudomonas* virus 42, *Cronobacter* virus CR3, *Cronobacter* virus CR8, *Cronobacter* virus CR9, *Cronobacter* virus PBES02, *Pectobacterium* virus phiTE, *Cronobacter* virus GAP31, *Escherichia* virus 4MG, *Salmonella* virus SE1, *Salmonella* virus SSE121, *Escherichia* virus FFH2, *Escherichia* virus FV3, *Escherichia* virus JES2013, *Escherichia* virus V5, *Brevibacillus* virus Abouo, *Brevibacillus* virus Davies, *Bacillus* virus Agate, *Bacillus* virus Bobb, *Bacillus* virus Bp8pC, *Erwinia* virus Deimos, *Erwinia* virus Ea35-70, *Erwinia* virus RAY, *Erwinia* virus Simmy50, *Erwinia* virus SpecialG, *Acinetobacter* virus AB 1, *Acinetobacter* virus AB2, *Acinetobacter* virus AbC62, *Acinetobacter* virus AP22, *Arthrobacter* virus ArV1, *Arthrobacter* virus Trina, *Bacillus* virus AvesoBmore, *Bacillus* virus B4, *Bacillus* virus Bigbertha, *Bacillus* virus Riley, *Bacillus* virus Spock, *Bacillus* virus Troll, *Bacillus* virus Bastille, *Bacillus* virus CAM003, *Bacillus* virus Bc431, *Bacillus* virus Bcp1, *Bacillus* virus BCP82, *Bacillus* virus BM15, *Bacillus* virus Deepblue, *Bacillus* virus JBP901, *Burkholderia* virus Bcep1, *Burkholderia* virus Bcep43, *Burkholderia* virus Bcep781, *Burkholderia* virus BcepNY3, *Xanthomonas* virus OP2, *Burkholderia* virus BcepMu, *Burkholderia* virus phiE255, *Aeromonas* virus 44RR2, *Mycobacterium* virus Alice, *Mycobacterium* virus Bxz1, *Mycobacterium* virus Dandelion, *Mycobacterium* virus HyRo, *Mycobacterium* virus I3, *Mycobacterium* virus Nappy, *Mycobacterium* virus Sebata, *Clostridium* virus phiC2, *Clostridium* virus phiCD27, *Clostridium* virus phiCD119, *Bacillus* virus CP51, *Bacillus* virus JL, *Bacillus* virus Shanette, *Escherichia* virus CVM10, *Escherichia* virus ep3, *Erwinia* virus Asesino, *Erwinia* virus EaH2, *Pseudomonas* virus EL, *Halomonas* virus HAP1, *Vibrio* virus VP882, *Brevibacillus* virus Jimmer, *Brevibacillus* virus Osiris, *Pseudomonas* virus Ab03, *Pseudomonas* virus KPP10, *Pseudomonas* virus PAKP3, *Sinorhizobium* virus M7, *Sinorhizobium* virus M12, *Sinorhizobium* virus N3, *Erwinia* virus Machina, *Arthrobacter* virus Brent, *Arthrobacter* virus Jawnski, *Arthrobacter* virus Martha, *Arthrobacter* virus Sonny, *Edwardsiella* virus MSW3, *Edwardsiella* virus PEi21, *Escherichia* virus Mu, *Shigella* virus SfMu, *Halobacterium* virus phiH, *Bacillus* virus Grass, *Bacillus* virus NIT1, *Bacillus* virus SPG24, *Aeromonas* virus 43, *Escherichia* virus P1, *Pseudomonas* virus CAb1, *Pseudomonas* virus CAb02, *Pseudomonas* virus JG004, *Pseudomonas* virus PAKP1, *Pseudomonas* virus PAKP4, *Pseudomonas* virus PaP1, *Burkholderia* virus BcepF1, *Pseudomonas* virus 141, *Pseudomonas* virus Ab28, *Pseudomonas* virus DL60, *Pseudomonas* virus DL68, *Pseudomonas* virus F8, *Pseudomonas* virus JG024, *Pseudomonas* virus KPP12, *Pseudomonas* virus LBL3, *Pseudomonas* virus LMA2, *Pseudomonas* virus PB1, *Pseudomonas* virus SN, *Pseudomonas* virus PA7, *Pseudomonas* virus phiKZ, *Rhizobium* virus RHEph4, *Ralstonia* virus RSF1, *Ralstonia* virus RSL2, *Ralstonia* virus RSL1, *Aeromonas* virus 25, *Aeromonas* virus 31, *Aeromonas* virus Aes12, *Aeromonas* virus Aes508, *Aeromonas* virus AS4, *Stenotrophomonas* virus IME13, *Staphylococcus* virus IPLAC1C, *Staphylococcus* virus SEP1, *Salmonella* virus SPN3US, *Bacillus* virus 1, *Geobacillus* virus GBSV1, *Yersinia* virus R1RT, *Yersinia* virus TG1, *Bacillus* virus G, *Bacillus* virus PBS1, *Microcystis* virus Ma-LMM01, *Vibrio* virus MAR, *Vibrio* virus VHML, *Vibrio* virus VP585, *Bacillus* virus BPS13, *Bacillus* virus Hakuna, *Bacillus* virus Megatron, *Bacillus* virus WPh, *Acinetobacter* virus AB3, *Acinetobacter* virus Abp1, *Acinetobacter* virus Fri 1, *Acinetobacter* virus IME200, *Acinetobacter* virus PD6A3, *Acinetobacter* virus PDAB9, *Acinetobacter* virus phiAB1, *Escherichia* virus K30, *Klebsiella* virus K5, *Klebsiella* virus K11, *Klebsiella* virus Kp1, *Klebsiella* virus KP32, *Klebsiella* virus KpV289, *Klebsiella* virus F19, *Klebsiella* virus K244, *Klebsiella* virus Kp2, *Klebsiella* virus KP34, *Klebsiella* virus KpV41, *Klebsiella* virus KpV71, *Klebsiella* virus KpV475, *Klebsiella* virus SU503, *Klebsiella* virus SU552A, *Pantoea* virus Limelight, *Pantoea* virus Limezero, *Pseudomonas* virus LKA1, *Pseudomonas* virus phiKMV, *Xanthomonas* virus f20, *Xanthomonas* virus f30, *Xylella* virus Prado, *Erwinia* virus Era103, *Escherichia* virus K5, *Escherichia* virus K1-5, *Escherichia* virus K1E, *Salmonella* virus SP6, *Escherichia* virus T7, *Kluyvera* virus Kvp1, *Pseudomonas* virus gh1, *Prochlorococcus* virus PSSP7, *Synechococcus* virus P60, *Synechococcus* virus Syn5, *Streptococcus* virus Cp1, *Streptococcus* virus Cp7, *Staphylococcus* virus 44AHJD, *Streptococcus* virus C1, *Bacillus* virus B 103, *Bacillus* virus GA1, *Bacillus* virus phi29, *Kurthia* virus 6, *Actinomyces* virus Av1, *Mycoplasma* virus P1, *Escherichia* virus 24B, *Escherichia* virus 933W, *Escherichia* virus Min27, *Escherichia* virus PA28, *Escherichia* virus Stx2 II, *Shigella* virus 7502Stx, *Shigella* virus POCJ13, *Escherichia* virus 191, *Escherichia* virus PA2, *Escherichia* virus TL2011, *Shigella* virus VASD, *Burkholderia* virus Bcep22, *Burkholderia* virus Bcepi102, *Burkholderia* virus Bcepmigl, *Burkholderia* virus DC1, *Bordetella* virus BPP1, *Burkholderia* virus BcepC6B, *Cellulophaga* virus Cba41, *Cellulophaga* virus Cba172, *Dinoroseobacter* virus DFL12, *Erwinia* virus Ea9-2, *Erwinia* virus Frozen, *Escherichia* virus phiV10, *Salmonella* virus Epsilon15, *Salmonella* virus SPN1S, *Pseudomonas* virus F116, *Pseudomonas* virus H66, *Escherichia* virus APEC5, *Escherichia* virus APEC7, *Escherichia* virus Bp4, *Escherichia* virus EC1UPM, *Escherichia* virus ECBP1, *Escherichia* virus G7C, *Escherichia* virus IME11, *Shigella* virus Sb1, *Achromobacter* virus Axp3, *Achromobacter* virus JWAlpha, *Edwardsiella* virus KF1, *Pseudomonas* virus KPP25, *Pseudomonas* virus R18, *Pseudomonas* virus Ab09, *Pseudomonas* virus LIT 1, *Pseudomonas* virus PA26, *Pseudomonas* virus Ab22, *Pseudomonas* virus CHU, *Pseudomonas* virus LUZ24, *Pseudomonas* virus PAA2, *Pseudomonas* virus PaP3, *Pseudomonas* virus PaP4, *Pseudomonas* virus TL, *Pseudomonas* virus KPP21, *Pseudomonas* virus LUZ7, *Escherichia* virus N4, *Salmonella* virus 9NA, *Salmonella* virus SP069, *Salmonella* virus BTP1, *Salmonella* virus HK620, *Salmonella* virus P22, *Salmonella* virus ST64T, *Shigella* virus Sf6, *Bacillus* virus Page, *Bacillus* virus Palmer, *Bacillus* virus Pascal, *Bacillus* virus Pony, *Bacillus* virus Pookie, *Escherichia* virus 172-1, *Escherichia* virus ECB2, *Escherichia* virus NJ01, *Escherichia* virus phiEco32, *Escherichia* virus Septima11, *Escherichia* virus SU10, *Brucella* virus Pr, *Brucella* virus Tb, *Escherichia* virus Pollock, *Salmonella* virus FSL SP-058, *Salmonella* virus FSL SP-076, *Helicobacter* virus 1961P, *Helicobacter* virus KHP30, *Helicobacter* virus KHP40, *Hamiltonella* virus APSE1, *Lactococcus* virus KSY1, *Phormidium* virus WMP3, *Phormidium* virus WMP4, *Pseudomonas* virus 119X, *Roseobacter* virus SIO1, *Vibrio* virus VpV262, *Vibrio* virus VC8, *Vibrio* virus VP2, *Vibrio* virus VP5, *Streptomyces* virus Amela, *Streptomyces* virus phiCAM, *Streptomyces* virus Aaronocolus, *Streptomyces* virus Caliburn, *Streptomyces* virus Danzina, *Streptomyces* virus Hydra, *Streptomyces* virus Izzy, *Streptomyces* virus Lannister, *Streptomyces* virus Lika, *Streptomyces* virus Sujidade, *Streptomyces* virus Zemlya, *Streptomyces* virus ELB20, *Streptomyces* virus R4, *Streptomyces* virus phiHau3, *Mycobacterium* virus Acadian, *Mycobacterium* virus Baee, *Mycobacterium* virus Reprobate, *Mycobacterium* virus Adawi, *Mycobacterium* virus Bane1, *Mycobacterium* virus BrownCNA, *Mycobacterium* virus Chrisnmich, *Mycobacterium* virus Cooper, *Mycobacterium* virus JAMaL, *Mycobacterium* virus Nigel, *Mycobacterium* virus Stinger, *Mycobacterium* virus Vincenzo, *Mycobacterium* virus Zemanar, *Mycobacterium* virus Apizium, *Mycobacterium* virus Manad, *Mycobacterium* virus Oline, *Mycobacterium* virus Osmaximus, *Mycobacterium* virus Pg1, *Mycobacterium* virus Soto, *Mycobacterium* virus Suffolk, *Mycobacterium* virus Athena, *Mycobacterium* virus Bernardo, *Mycobacterium* virus Gadjet, *Mycobacterium* virus Pipefish, *Mycobacterium* virus Godines, *Mycobacterium* virus Rosebush, *Mycobacterium* virus Babsiella, *Mycobacterium* virus Brujita, *Mycobacterium* virus Che9c, *Mycobacterium* virus Sbash, *Mycobacterium* virus Hawkeye, *Mycobacterium* virus Plot, *Salmonella* virus AG11, *Salmonella* virus Entl, *Salmonella* virus f18SE, *Salmonella* virus Jersey, *Salmonella* virus L13, *Salmonella* virus LSPA1, *Salmonella* virus SE2, *Salmonella* virus SETP3, *Salmonella* virus SETP7, *Salmonella* virus SETP13, *Salmonella* virus SP101, *Salmonella* virus SS3e, *Salmonella* virus wks13, *Escherichia* virus K1G, *Escherichia* virus K1H, *Escherichia* virus K1ind1, *Escherichia* virus K1ind2, *Salmonella* virus SP31, *Leuconostoc* virus Lmd1, *Leuconostoc* virus LN03, *Leuconostoc* virus LN04, *Leuconostoc* virus LN12, *Leuconostoc* virus LN6B, *Leuconostoc* virus P793, *Leuconostoc* virus 1A4, *Leuconostoc* virus Ln8, *Leuconostoc* virus Ln9, *Leuconostoc* virus LN25, *Leuconostoc* virus LN34, *Leuconostoc* virus LNTR3, *Mycobacterium* virus Bongo, *Mycobacterium* virus Rey, *Mycobacterium* virus Butters, *Mycobacterium* virus Michelle, *Mycobacterium* virus Charlie, *Mycobacterium* virus Pipsqueaks, *Mycobacterium* virus Xeno, *Mycobacterium* virus Panchino, *Mycobacterium* virus Phrann, *Mycobacterium* virus Redi, *Mycobacterium* virus Skinnyp, *Gordonia* virus BaxterFox, *Gordonia* virus Yeezy, *Gordonia* virus Kita, *Gordonia* virus Zirinka, *Gorrdonia* virus Nymphadora, *Mycobacterium* virus Bignuz, *Mycobacterium* virus Brusacoram, *Mycobacterium* virus Donovan, *Mycobacterium* virus Fishburne, *Mycobacterium* virus Jebeks, *Mycobacterium* virus Malithi, *Mycobacterium* virus Phayonce, *Enterobacter* virus F20, *Klebsiella* virus 1513, *Klebsiella* virus KLPN1, *Klebsiella* virus KP36, *Klebsiella* virus PKP126, *Klebsiella* virus Sushi, *Escherichia* virus AHP42, *Escherichia* virus AHS24, *Escherichia* virus AKS96, *Escherichia* virus C119, *Escherichia* virus E41c, *Escherichia* virus Eb49, *Escherichia* virus Jk06, *Escherichia* virus KP26, *Escherichia* virus Rogue1, *Escherichia* virus ACGM12, *Escherichia* virus Rtp, *Escherichia* virus ADB2, *Escherichia* virus JMPW1, *Escherichia* virus JMPW2, *Escherichia* virus Ti, *Shigella* virus PSf2, *Shigella* virus Shfl1, *Citrobacter* virus Stevie, *Escherichia* virus TLS, *Salmonella* virus SP126, *Cronobacter* virus Esp2949-1, *Pseudomonas* virus Ab18, *Pseudomonas* virus Ab19, *Pseudomonas* virus PaMx11, *Arthrobacter* virus Amigo, *Propionibacterium* virus Anatole, *Propionibacterium* virus B3, *Bacillus* virus Andromeda, *Bacillus* virus Blastoid, *Bacillus* virus Curly, *Bacillus* virus Eoghan, *Bacillus* virus Finn, *Bacillus* virus Glittering, *Bacillus* virus Riggi, *Bacillus* virus Taylor, *Gordonia* virus Attis, *Mycobacterium* virus Barnyard, *Mycobacterium* virus Konstantine, *Mycobacterium* virus Predator, *Mycobacterium* virus Bernal13, *Staphylococcus* virus 13, *Staphylococcus* virus 77, *Staphylococcus* virus 108PVL, *Mycobacterium* virus Bron, *Mycobacterium* virus Faith1, *Mycobacterium* virus Joedirt, *Mycobacterium* virus Rumpelstiltskin, *Lactococcus* virus bIL67, *Lactococcus* virus c2, *Lactobacillus* virus c5, *Lactobacillus* virus Ld3, *Lactobacillus* virus Ld17, *Lactobacillus* virus Ld25A, *Lactobacillus* virus LLKu, *Lactobacillus* virus phiLdb, *Cellulophaga* virus Cba121, *Cellulophaga* virus Cba171, *Cellulophaga* virus Cba181, *Cellulophaga* virus ST, *Bacillus* virus 250, *Bacillus* virus IEBH, *Mycobacterium* virus Ardmore, *Mycobacterium* virus Avani, *Mycobacterium* virus Boomer, *Mycobacterium* virus Che8, *Mycobacterium* virus Che9d, *Mycobacterium* virus Deadp, *Mycobacterium* virus Dlane, *Mycobacterium* virus Dorothy, *Mycobacterium* virus Dotproduct, *Mycobacterium* virus Drago, *Mycobacterium* virus Fruitloop, *Mycobacterium* virus Gumbie, *Mycobacterium* virus Ibhubesi, *Mycobacterium* virus Llij, *Mycobacterium* virus Mozy, *Mycobacterium* virus Mutaforma13, *Mycobacterium* virus Pacc40, *Mycobacterium* virus PMC, *Mycobacterium* virus Ramsey, *Mycobacterium* virus Rockyhorror, *Mycobacterium* virus SG4, *Mycobacterium* virus Shauna1, *Mycobacterium* virus Shilan, *Mycobacterium* virus Spartacus, *Mycobacterium* virus Taj, *Mycobacterium* virus Tweety, *Mycobacterium* virus Wee, *Mycobacterium* virus Yoshi, *Salmonella* virus Chi, *Salmonella* virus FSLSP030, *Salmonella* virus FSLSP088, *Salmonella* virus iEPS5, *Salmonella* virus SPN19, *Mycobacterium* virus 244, *Mycobacterium* virus Bask21, *Mycobacterium* virus CJW1, *Mycobacterium* virus Eureka, *Mycobacterium* virus Kostya, *Mycobacterium* virus Porky, *Mycobacterium* virus Pumpkin, *Mycobacterium* virus Sirduracell, *Mycobacterium* virus Toto, *Mycobacterium* virus Corndog, *Mycobacterium* virus Firecracker, *Rhodobacter* virus RcCronus, *Pseudomonas* virus D3112, *Pseudomonas* virus DMS3, *Pseudomonas* virus FHA0480, *Pseudomonas* virus LPB1, *Pseudomonas* virus MP22, *Pseudomonas* virus MP29, *Pseudomonas* virus MP38, *Pseudomonas* virus PA1KOR, *Pseudomonas* virus D3, *Pseudomonas* virus PMG1, *Arthrobacter* virus Decurro, *Gordonia* virus Demosthenes, *Gordonia* virus Katyusha, *Gordonia* virus Kvothe, *Propionibacterium* virus B22, *Propionibacterium* virus Doucette, *Propionibacterium* virus E6, *Propionibacterium* virus G4, *Burkholderia* virus phi6442, *Burkholderia* virus phi1026b, *Burkholderia* virus phiE125, *Edwardsiella* virus eiAU, *Mycobacterium* virus Ff47, *Mycobacterium* virus Muddy, *Mycobacterium* virus Gaia, *Mycobacterium* virus Giles, *Arthrobacter* virus Captnmurica, *Arthrobacter* virus Gordon, *Gordonia* virus GordTnk2, *Paenibacillus* virus Harrison, *Escherichia* virus EK99P1, *Escherichia* virus HK578, *Escherichia* virus JL1, *Escherichia* virus SSL2009a, *Escherichia* virus YD2008s, *Shigella* virus EP23, *Sodalis* virus SO1, *Escherichia* virus HK022, *Escherichia* virus HK75, *Escherichia* virus HK97, *Escherichia* virus HK106, *Escherichia* virus HK446, *Escherichia* virus HK542, *Escherichia* virus HK544, *Escherichia* virus HK633, *Escherichia* virus mEp234, *Escherichia* virus mEp235, *Escherichia* virus mEpX1, *Escherichia* virus mEpX2, *Escherichia* virus mEp043, *Escherichia* virus mEp213, *Escherichia* virus mEp237, *Escherichia* virus mEp390, *Escherichia* virus mEp460, *Escherichia* virus mEp505, *Escherichia* virus mEp506, *Brevibacillus* virus Jenst, *Achromobacter* virus 83-24, *Achromobacter* virus JWX, *Arthrobacter* virus Kellezzio, *Arthrobacter* virus Kitkat, *Arthrobacter* virus Bennie, *Arthrobacter* virus DrRobert, *Arthrobacter* virus Glenn, *Arthrobacter* virus HunterDalle, *Arthrobacter* virus Joann, *Arthrobacter* virus Korra, *Arthrobacter* virus Preamble, *Arthrobacter* virus Pumancara, *Arthrobacter* virus Wayne, *Mycobacterium* virus Alma, *Mycobacterium* virus Arturo, *Mycobacterium* virus Astro, *Mycobacterium* virus Backyardigan, *Mycobacterium* virus BBPiebs31, *Mycobacterium* virus Benedict, *Mycobacterium* virus Bethlehem, *Mycobacterium* virus Billknuckles, *Mycobacterium* virus Bruns, *Mycobacterium* virus Bxb 1, *Mycobacterium* virus Bxz2, *Mycobacterium* virus Che12, *Mycobacterium* virus Cuco, *Mycobacterium* virus D29, *Mycobacterium* virus Doom, *Mycobacterium* virus Ericb, *Mycobacterium* virus Euphoria, *Mycobacterium* virus George, *Mycobacterium* virus Gladiator, *Mycobacterium* virus Goose, *Mycobacterium* virus Hammer, *Mycobacterium* virus Heldan, *Mycobacterium* virus Jasper, *Mycobacterium* virus JC27, *Mycobacterium* virus Jeffabunny, *Mycobacterium* virus JHC 117, *Mycobacterium* virus KBG, *Mycobacterium* virus Kssjeb, *Mycobacterium* virus Kugel, *Mycobacterium* virus L5, *Mycobacterium* virus Lesedi, *Mycobacterium* virus LHTSCC, *Mycobacterium* virus lockley, *Mycobacterium* virus Marcell, *Mycobacterium* virus Microwolf, *Mycobacterium* virus Mrgordo, *Mycobacterium* virus Museum, *Mycobacterium* virus Nepal, *Mycobacterium* virus Packman, *Mycobacterium* virus Peaches, *Mycobacterium* virus Perseus, *Mycobacterium* virus Pukovnik, *Mycobacterium* virus Rebeuca, *Mycobacterium* virus Redrock, *Mycobacterium* virus Ridgecb, *Mycobacterium* virus Rockstar, *Mycobacterium* virus Saintus, *Mycobacterium* virus Skipole, *Mycobacterium* virus Solon, *Mycobacterium* virus Switzer, *Mycobacterium* virus SWU1, *Mycobacterium* virus Ta17a, *Mycobacterium* virus Tiger, *Mycobacterium* virus Timshel, *Mycobacterium* virus Trixie, *Mycobacterium* virus Turbido, *Mycobacterium* virus Twister, *Mycobacterium* virus U2, *Mycobacterium* virus Violet, *Mycobacterium* virus Wonder, *Escherichia* virus DE3, *Escherichia* virus HK629, *Escherichia* virus HK630, *Escherichia* virus lambda, *Arthrobacter* virus Laroye, *Mycobacterium* virus Halo, *Mycobacterium* virus Liefie, *Mycobacterium* virus Marvin, *Mycobacterium* virus Mosmoris, *Arthrobacter* virus Circum, *Arthrobacter* virus Mudcat, *Escherichia* virus N15, *Escherichia* virus 9g, *Escherichia* virus JenK1, *Escherichia* virus JenP1, *Escherichia* virus JenP2, *Pseudomonas* virus NP1, *Pseudomonas* virus PaMx25, *Mycobacterium* virus Baka, *Mycobacterium* virus Courthouse, *Mycobacterium* virus Littlee, *Mycobacterium* virus Omega, *Mycobacterium* virus Optimus, *Mycobacterium* virus Thibault, *Polaribacter* virus P12002L, *Polaribacter* virus P12002S, *Nonlabens* virus P12024L, *Nonlabens* virus P12024S, *Thermus* virus P23-45, *Thermus* virus P74-26, *Listeria* virus LP26, *Listeria* virus LP37, *Listeria* virus LP110, *Listeria* virus LP114, *Listeria* virus P70, *Propionibacterium* virus ATCC29399BC, *Propionibacterium* virus ATCC29399BT, *Propionibacterium* virus Attacne, *Propionibacterium* virus Keiki, *Propionibacterium* virus Kubed, *Propionibacterium* virus Lauchelly, *Propionibacterium* virus MrAK, *Propionibacterium* virus Ouroboros, *Propionibacterium* virus P91, *Propionibacterium* virus P105, *Propionibacterium* virus P144, *Propionibacterium* virus P1001, *Propionibacterium* virus P1.1, *Propionibacterium* virus P100A, *Propionibacterium* virus P100D, *Propionibacterium* virus P101A, *Propionibacterium* virus P104A, *Propionibacterium* virus PA6, *Propionibacterium* virus Pacnes201215, *Propionibacterium* virus PAD20, *Propionibacterium* virus PAS50, *Propionibacterium* virus PHL009M11, *Propionibacterium* virus PHL025M00, *Propionibacterium* virus PHL037M02, *Propionibacterium* virus PHL041M10, *Propionibacterium* virus PHL060L00, *Propionibacterium* virus PHL067M01, *Propionibacterium* virus PHL070N00, *Propionibacterium* virus PHL071N05, *Propionibacterium* virus PHL082M03, *Propionibacterium* virus PHL092M00, *Propionibacterium* virus PHL095N00, *Propionibacterium* virus PHL111M01, *Propionibacterium* virus PHL112N00, *Propionibacterium* virus PHL113M01, *Propionibacterium* virus PHL114L00, *Propionibacterium* virus PHL116M00, *Propionibacterium* virus PHL117M00, *Propionibacterium* virus PHL117M01, *Propionibacterium* virus PHL132N00, *Propionibacterium* virus PHL141N00, *Propionibacterium* virus PHL151M00, *Propionibacterium* virus PHL151N00, *Propionibacterium* virus PHL152M00, *Propionibacterium* virus PHL163M00, *Propionibacterium* virus PHL171M01, *Propionibacterium* virus PHL179M00, *Propionibacterium* virus PHL194M00, *Propionibacterium* virus PHL199M00, *Propionibacterium* virus PHL301M00, *Propionibacterium* virus PHL308M00, *Propionibacterium* virus Pirate, *Propionibacterium* virus Procrass1, *Propionibacterium* virus SKKY, *Propionibacterium* virus Solid, *Propionibacterium* virus Stormborn, *Propionibacterium* virus Wizzo, *Pseudomonas* virus PaMx28, *Pseudomonas* virus PaMx74, *Mycobacterium* virus Patience, *Mycobacterium* virus PBI1, *Rhodococcus* virus Pepy6, *Rhodococcus* virus Poco6, *Propionibacterium* virus PFR1, *Streptomyces* virus phiBT1, *Streptomyces* virus phiC31, *Streptomyces* virus TG1, *Caulobacter* virus Karma, *Caulobacter* virus Magneto, *Caulobacter* virus phiCbK, *Caulobacter* virus Rogue, *Caulobacter* virus Swift, *Staphylococcus* virus 11, *Staphylococcus* virus 29, *Staphylococcus* virus 37, *Staphylococcus* virus 53, *Staphylococcus* virus 55, *Staphylococcus* virus 69, *Staphylococcus* virus 71, *Staphylococcus* virus 80, *Staphylococcus* virus 85, *Staphylococcus* virus 88, *Staphylococcus* virus 92, *Staphylococcus* virus 96, *Staphylococcus* virus 187, *Staphylococcus* virus 52a, *Staphylococcus* virus 80alpha, *Staphylococcus* virus CNPH82, *Staphylococcus* virus EW, *Staphylococcus* virus IPLA5, *Staphylococcus* virus IPLA7, *Staphylococcus* virus IPLA88, *Staphylococcus* virus PH15, *Staphylococcus* virus phiETA, *Staphylococcus* virus phiETA2, *Staphylococcus* virus phiETA3, *Staphylococcus* virus phiMR11, *Staphylococcus* virus phiMR25, *Staphylococcus* virus phiNM1, *Staphylococcus* virus phiNM2, *Staphylococcus* virus phiNM4, *Staphylococcus* virus SAP26, *Staphylococcus* virus X2, *Enterococcus* virus FL1, *Enterococcus* virus FL2, *Enterococcus* virus FL3, *Lactobacillus* virus ATCC8014, *Lactobacillus* virus phiJL1, *Pediococcus* virus cIP1, *Aeromonas* virus pIS4A, *Listeria* virus LP302, *Listeria* virus PSA, *Methanobacterium* virus psiM1, *Roseobacter* virus RDJL1, *Roseobacter* virus RDJL2, *Rhodococcus* virus RER2, *Enterococcus* virus BC611, *Enterococcus* virus IMEEF1, *Enterococcus* virus SAP6, *Enterococcus* virus VD13, *Streptococcus* virus SPQS1, *Mycobacterium* virus Papyrus, *Mycobacterium* virus Send513, *Burkholderia* virus KL1, *Pseudomonas* virus 73, *Pseudomonas* virus Ab26, *Pseudomonas* virus Kakheti25, *Escherichia* virus Cajan, *Escherichia* virus Seurat, *Staphylococcus* virus SEP9, *Staphylococcus* virus Sextaec, *Streptococcus* virus 858, *Streptococcus* virus 2972, *Streptococcus* virus ALQ132, *Streptococcus* virus O1205, *Streptococcus* virus Sfi11, *Streptococcus* virus 7201, *Streptococcus* virus DT1, *Streptococcus* virus phiAbc2, *Streptococcus* virus Sfi19, *Streptococcus* virus Sfi21, *Paenibacillus* virus Diva, *Paenibacillus* virus Hb10c2, *Paenibacillus* virus Rani, *Paenibacillus* virus Shelly, *Paenibacillus* virus Sitara, *Paenibacillus* virus Willow, *Lactococcus* virus 712, *Lactococcus* virus ASCC191, *Lactococcus* virus ASCC273, *Lactococcus* virus ASCC281, *Lactococcus* virus ASCC465, *Lactococcus* virus ASCC532, *Lactococcus* virus Bibb29, *Lactococcus* virus bIL170, *Lactococcus* virus CB13, *Lactococcus* virus CB 14, *Lactococcus* virus CB19, *Lactococcus* virus CB20, *Lactococcus* virus jj50, *Lactococcus* virus P2, *Lactococcus* virus P008, *Lactococcus* virus sk1, *Lactococcus* virus S14, *Bacillus* virus Slash, *Bacillus* virus Stahl, *Bacillus* virus Staley, *Bacillus* virus Stills, *Gordonia* virus Bachita, *Gordonia* virus ClubL, *Gordonia* virus OneUp, *Gordonia* virus Smoothie, *Gordonia* virus Soups, *Bacillus* virus SPbeta, *Vibrio* virus MAR10, *Vibrio* virus SSP002, *Escherichia* virus AKFV33, *Escherichia* virus BF23, *Escherichia* virus DT57C, *Escherichia* virus EPS7, *Escherichia* virus FFH1, *Escherichia* virus H8, *Escherichia* virus slur09, *Escherichia* virus T5, *Salmonella* virus 118970sa12, *Salmonella* virus Shivani, *Salmonella* virus SPC35, *Salmonella* virus Stitch, *Arthrobacter* virus Tank, *Tsukamurella* virus TIN2, *Tsukamurella* virus TIN3, *Tsukamurella* virus TIN4, *Rhodobacter* virus RcSpartan, *Rhodobacter* virus RcTitan, *Mycobacterium* virus Anaya, *Mycobacterium* virus Angelica, *Mycobacterium* virus Crimd, *Mycobacterium* virus Fionnbarth, *Mycobacterium* virus Jaws, *Mycobacterium* virus Larva, *Mycobacterium* virus Macncheese, *Mycobacterium* virus Pixie, *Mycobacterium* virus TM4, *Bacillus* virus BMBtp2, *Bacillus* virus TP21, *Geobacillus* virus Tp84, *Staphylococcus* virus 47, *Staphylococcus* virus 3a, *Staphylococcus* virus 42e, *Staphylococcus* virus IPLA35, *Staphylococcus* virus phi12, *Staphylococcus* virus phiSLT, *Mycobacterium* virus 32HC, *Rhodococcus* virus RGL3, *Paenibacillus* virus Vegas, *Gordonia* virus Vendetta, *Bacillus* virus Wbeta, *Mycobacterium* virus Wildcat, *Gordonia* virus Twister6, *Gordonia* virus Wizard, *Gordonia* virus Hotorobo, *Gordonia* virus Monty, *Gordonia* virus Woes, *Xanthomonas* virus CP1, *Xanthomonas* virus OP1, *Xanthomonas* virus phi17, *Xanthomonas* virus Xop411, *Xanthomonas* virus Xp10, *Streptomyces* virus TP1604, *Streptomyces* virus YDN12, *Alphaproteobacteria* virus phiJ1001, *Pseudomonas* virus LKO4, *Pseudomonas* virus M6, *Pseudomonas* virus MP1412, *Pseudomonas* virus PAE1, *Pseudomonas* virus Yua, *Pseudoalteromonas* virus PM2, *Pseudomonas* virus phi6, *Pseudomonas* virus phi8, *Pseudomonas* virus phi12, *Pseudomonas* virus phi13, *Pseudomonas* virus phi2954, *Pseudomonas* virus phiNN, *Pseudomonas* virus phiYY, *Vibrio* virus fs1, *Vibrio* virus VGJ, *Ralstonia* virus RS603, *Ralstonia* virus RSM1, *Ralstonia* virus RSM3, *Escherichia* virus M13, *Escherichia* virus 122, *Salmonella* virus IKe, *Acholeplasma* virus L51, *Vibrio* virus fs2, *Vibrio* virus VFJ, *Escherichia* virus If1,

*Propionibacterium* virus B5, *Pseudomonas* virus Pf1, *Pseudomonas* virus Pf3, *Ralstonia* virus PE226, *Ralstonia* virus RSS1, *Spiroplasma* virus SVTS2, *Stenotrophomonas* virus PSH1, *Stenotrophomonas* virus SMA6, *Stenotrophomonas* virus SMA7, *Stenotrophomonas* virus SMA9, *Vibrio* virus CTXphi, *Vibrio* virus KSF1, *Vibrio* virus VCY, *Vibrio* virus Vf33, *Vibrio* virus VfO3K6, *Xanthomonas* virus Cflc, *Spiroplasma* virus C74, *Spiroplasma* virus R8A2B, *Spiroplasma* virus SkV1CR23x, *Escherichia* virus FI, *Escherichia* virus Qbeta, *Escherichia* virus BZ13, *Escherichia* virus MS2, *Escherichia* virus alpha3, *Escherichia* virus ID21, *Escherichia* virus ID32, *Escherichia* virus ID62, *Escherichia* virus NC28, *Escherichia* virus NC29, *Escherichia* virus NC35, *Escherichia* virus phiK, *Escherichia* virus St1, *Escherichia* virus WA45, *Escherichia* virus G4, *Escherichia* virus ID52, *Escherichia* virus Talmos, *Escherichia* virus phiX174, *Bdellovibrio* virus MAC1, *Bdellovibrio* virus MH2K, *Chlamydia* virus Chp1, *Chlamydia* virus Chp2, *Chlamydia* virus CPAR39, *Chlamydia* virus CPG1, *Spiroplasma* virus SpV4, *Acholeplasma* virus L2, *Pseudomonas* virus PR4, *Pseudomonas* virus PRD1, *Bacillus* virus AP50, *Bacillus* virus Bam35, *Bacillus* virus GIL16, *Bacillus* virus Wip1, *Escherichia* virus phi80, *Escherichia* virus RB42, *Escherichia* virus T2, *Escherichia* virus T3, *Escherichia* virus T6, *Escherichia* virus VT2-Sa, *Escherichia* virus VT1-Sakai, *Escherichia* virus VT2-Sakai, *Escherichia* virus CP-933V, *Escherichia* virus P27, *Escherichia* virus Stx2phi-I, *Escherichia* virus Stx1phi, *Escherichia* virus Stx2phi-II, *Escherichia* virus CP-1639, based on the *Escherichia* virus BP-4795, *Escherichia* virus 86, *Escherichia* virus Min27, *Escherichia* virus 2851, *Escherichia* virus 1717, *Escherichia* virus YYZ-2008, *Escherichia* virus EC026_P06, *Escherichia* virus ECO103_P15, *Escherichia* virus ECO103_P12, *Escherichia* virus ECO111_P16, *Escherichia* virus ECO111_P11, *Escherichia* virus VT2phi_272, *Escherichia* virus TL-2011c, *Escherichia* virus P13374, *Escherichia* virus Sp5.

In one embodiment, the bacterial virus particles target *E. coli* and includes the capsid of a bacteriophage selected in the group consisting of BW73, B278, D6, D108, E, El, E24, E41, FI-2, FI-4, FI-5, HI8A, Ffl8B, i, MM, Mu, 025, PhI-5, Pk, PSP3, P1, P1D, P2, P4, S1, Wφ, φK13, φ1, φ2, φ7, φ92, 7 A, 8φ, 9φ, 18, 28-1, 186, 299, HH-*Escherichia* (2), AB48, CM, C4, C16, DD-VI, E4, E7, E28, FI, FI3, H, H1, H3, H8, K3, M, N, ND-2, ND-3, ND4, ND-5, ND6, ND-7, Ox-I, Ox-2, Ox-3, Ox-4, Ox-5, Ox-6, Ph-I, RB42, RB43, RB49, RB69, S, Sal-I, Sal-2, Sal-3, Sal-4, Sal-5, Sal-6, TC23, TC45, TuII*-6, TuIP-24, TuII*46, TuIP-60, T2, T4, T6, T35, α1, 1, IA, 3, 3A, 3T+, 5φ, 9266Q, CFO103, HK620, J, K, K1F, m59, no. A, no. E, no. 3, no. 9, N4, sd, T3, T7, WPK, W31, ΔH, φC3888, φK3, φK7, φK12, φV-1, Φ04-CF, Φ05, Φ06, Φ07, φ1, φ1.2, φ20, φ95, φ263, φ1O92, φ1, φ11, Ω8, 1, 3, 7, 8, 26, 27, 28-2, 29, 30, 31, 32, 38, 39, 42, 933W, NN-*Escherichia* (1), Esc-7-11, AC30, CVX-5, C1, DDUP, EC1, EC2, E21, E29, F1, F26S, F27S, Hi, HK022, HK97, HK139, HK253, HK256, K7, ND-I, PA-2, q, S2, T1,), T3C, T5, UC-I, w, β4, γ2, λ, ΦD326, φγ, Φ06, Φ7, Φ10, φ80, χ, 2, 4, 4A, 6, 8A, 102, 150, 168, 174, 3000, AC6, AC7, AC28, AC43, AC50, AC57, AC81, AC95, HK243, K1O, ZG/3A, 5, 5A, 21EL, H19-J and 933H.

As used herein, a "prebiotic" refers to an ingredient that allows specific changes, both in the composition and/or activity in the gastrointestinal microbiota that may confer benefits upon the host. A prebiotic can be a comestible food or beverage or ingredient thereof. A prebiotic may be a selectively fermented ingredient. Prebiotics may include complex carbohydrates, amino acids, peptides, minerals, or other essential nutritional components for the survival of the bacterial composition. Prebiotics include, but are not limited to, amino acids, biotin, fructo-oligosaccharide, galacto-oligosaccharides, hemicelluloses (e.g., arabinoxylan, xylan, xyloglucan, and glucomannan), inulin, chitin, lactulose, mannan oligosaccharides, oligofructose-enriched inulin, gums (e.g., guar gum, gum arabic and carregenaan), oligofructose, oligodextrose, tagatose, resistant maltodextrins (e.g., resistant starch), trans-galactooligosaccharide, pectins (e.g., xylogalactouronan, citrus pectin, apple pectin, and rhamnogalacturonan-I), dietary fibers (e.g., soy fiber, sugarbeet fiber, pea fiber, corn bran, and oat fiber) and xylooligosaccharides.

As use herein, a "probiotic" refers to a dietary supplement based on living microbes which, when taken in adequate quantities, has a beneficial effect on the host organism by strengthening the intestinal ecosystem. Probiotic can comprise a non-pathogenic bacterial or fungal population, e.g., an immunomodulatory bacterial population, such as an anti-inflammatory bacterial population, with or without one or more prebiotics. They contain a sufficiently high number of living and active probiotic microorganisms that can exert a balancing action on gut flora by direct colonisation. It must be noted that, for the purposes of the present description, the term "probiotic" is taken to mean any biologically active form of probiotic, preferably but not limited to lactobacilli, bifidobacteria, streptococci, enterococci, propionibacteria or saccharomycetes but even other microorganisms making up the normal gut flora, or also fragments of the bacterial wall or of the DNA of these microorganisms. These compositions are advantageous in being suitable for safe administration to humans and other mammalian subjects and are efficacious for the treatment, prevention, of a bacterial infection. Probiotics include, but are not limited to lactobacilli, bifidobacteria, streptococci, enterococci, propionibacteria, saccharomycetes, lactobacilli, bifidobacteria, or proteobacteria.

The antibiotic can be selected from the group consisting in penicillins such as penicillin G, penicillin K, penicillin N, penicillin O, penicillin V, methicillin, benzylpenicillin, nafcillin, oxacillin, cloxacillin, dicloxacillin, ampicillin, amoxicillin, pivampicillin, hetacillin, bacampicillin, metampicillin, talampicillin, epicillin, carbenicillin, ticarcillin, temocillin, mezlocillin, and piperacillin; cephalosporins such as cefacetrile, cefadroxil, cephalexin, cefaloglycin, cefalonium, cefaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefmetazole, cefotetan, cefoxitin, loracarbef, cefbuperazone, cefminox, cefotetan, cefoxitin, cefotiam, cefcapene, cefdaloxime, cefdinir, cefditoren, cefetamet, cefixime, cefmenoxime, cefodizime, cefotaxime, cefovecin, cefpimizole, cefpodoxime, cefteram, ceftamere, ceftibuten, ceftiofur, ceftiolene, ceftizoxime, ceftriaxone, cefoperazone, ceftazidime, latamoxef, cefclidine, cefepime, cefluprenam, cefoselis, cefozopran, cefpirome, cefquinome, flomoxef, ceftobiprole, ceftaroline, ceftolozane, cefaloram, cefaparole, cefcanel, cefedrolor, cefempidone, cefetrizole, cefivitril, cefmatilen, cefmepidium, cefoxazole, cefrotil, cefsumide, ceftioxide, cefuracetime, and nitrocefin; polymyxins such as polysporin, neosporin, polymyxin B, and polymyxin E, rifampicins such as rifampicin, rifapentine, and rifaximin; Fidaxomicin; quinolones such as cinoxacin, nalidixic acid, oxolinic acid, piromidic acid, pipemidic acid, rosoxacin, ciprofloxacin, enoxacin, fleroxacin, lomefloxacin, nadifloxacin, norfloxacin, ofloxacin, pefloxacin, rufloxacin, balofloxacin, grepafloxacin, levofloxacin, pazufloxacin, temafloxacin, tosufloxacin, clinafloxacin, gatifloxacin, gemifloxacin, moxifloxacin, sitafloxacin, trovafloxacin, prulifloxacin, delafloxacin, nemonoxacin, and zabofloxacin; sulfonamides such as sulfafurazole, sulfacetamide, sulfadiazine, sulfadimidine, sulfafurazole, sulfisomidine, sulfadoxine, sulfamethoxazole, sulfamoxole, sulfanitran, sulfadimethoxine, sulfametho-xypyridazine, sulfametoxydiazine, sulfadoxine, sulfametopyrazine, and terephtyl; macrolides such as azithromycin, clarithromycin, erythromycin, fidaxomicin, telithromycin, carbomycin A, josamycin, kitasamycin, midecamycin, oleandomycin, solithromycin, spiramycin, troleandomycin, tylosin, and roxithromycin; ketolides such as telithromycin, and cethromycin; 1luoroketolides such as solithromycin; lincosamides such as lincomycin, clindamycin, and pirlimycin; tetracyclines such as demeclocycline, doxycycline, minocycline, oxytetracycline, and tetracycline; aminoglycosides such as amikacin, dibekacin, gentamicin, kanamycin, neomycin, netilmicin, sisomicin, tobramycin, paromomycin, and streptomycin; ansamycins such as geldanamycin, herbimycin, and rifaximin; carbacephems such as loracarbef; carbapenems such as ertapenem, doripenem, imipenem (or cilastatin), and meropenem; glycopeptides such as teicoplanin, vancomycin, telavancin, dalbavancin, and oritavancin; lincosamides such as clindamycin and lincomycin; lipopeptides such as daptomycin; monobactams such as aztreonam; nitrofurans such as furazolidone, and nitrofurantoin; oxazolidinones such as linezolid, posizolid, radezolid, and torezolid; teixobactin, clofazimine, dapsone, capreomycin, cycloserine, ethambutol, ethionamide, isoniazid, pyrazinamide, rifabutin, arsphenamine, chloramphenicol, fosfomycin, fusidic acid, metronidazole, mupirocin, platensimycin, quinupristin (or dalfopristin), thiamphenicol, tigecycline, tinidazole, trimethoprim, alatrofloxacin, fidaxomycin, nalidixice acide, rifampin, derivatives and combination thereof.

The present invention provides pharmaceutical or veterinary compositions comprising one or more of the bacterial delivery vehicles disclosed herein and a pharmaceutically-acceptable carrier. Generally, for pharmaceutical use, the bacterial delivery vehicles may be formulated as a pharmaceutical preparation or compositions comprising at least one bacterial delivery vehicles and at least one pharmaceutically acceptable carrier, diluent or excipient, and optionally one or more further pharmaceutically active compounds. Such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such administration forms may be solid, semi-solid or liquid, depending on the manner and route of administration. For example, formulations for oral administration may be provided with an enteric coating that will allow the synthetic bacterial delivery vehicles in the formulation to resist the gastric environment and pass into the intestines. More generally, synthetic bacterial delivery vehicle formulations for oral administration may be suitably formulated for delivery into any desired part of the gastrointestinal tract. In addition, suitable suppositories may be used for delivery into the gastrointestinal tract. Various pharmaceutically acceptable carriers, diluents and excipients useful in bacterial delivery vehicle compositions are known to the skilled person.

Also provided are methods for treating a bacterial infection using the synthetic bacterial delivery vehicles disclosed herein. The methods include administering the synthetic bacterial delivery vehicles or compositions disclosed herein to a subject having a bacterial infection in need of treatment. In some embodiments, the subject is a mammal. In some embodiments, the subject is a human.

The pharmaceutical or veterinary composition according to the disclosure may further comprise a pharmaceutically acceptable vehicle. A solid pharmaceutically acceptable vehicle may include one or more substances which may also act as flavouring agents, lubricants, solubilisers, suspending agents, dyes, fillers, glidants, compression aids, inert binders, sweeteners, preservatives, dyes, coatings, or tablet-disintegrating agents. Suitable solid vehicles include, for example calcium phosphate, magnesium stearate, talc, sugars, lactose, dextrin, starch, gelatin, cellulose, polyvinylpyrrolidine, low melting waxes and ion exchange resins.

The pharmaceutical or veterinary composition may be prepared as a sterile solid composition that may be suspended at the time of administration using sterile water, saline, or other appropriate sterile injectable medium. The pharmaceutical or veterinary compositions of the disclosure may be administered orally in the form of a sterile solution or suspension containing other solutes or suspending agents (for example, enough saline or glucose to make the solution isotonic), bile salts, acacia, gelatin, sorbitan monoleate, polysorbate 8o (oleate esters of sorbitol and its anhydrides copolymerized with ethylene oxide) and the like. The particles according to the disclosure can also be administered orally either in liquid or solid composition form. Compositions suitable for oral administration include solid forms, such as pills, capsules, granules, tablets, and powders, and liquid forms, such as solutions, syrups, elixirs, and suspensions. Forms useful for enteral administration include sterile solutions, emulsions, and suspensions.

The bacterial delivery vehicles according to the disclosure may be dissolved or suspended in a pharmaceutically acceptable liquid vehicle such as water, an organic solvent, a mixture of both or pharmaceutically acceptable oils or fats. The liquid vehicle can contain other suitable pharmaceutical additives such as solubilisers, emulsifiers, buffers, preservatives, sweeteners, flavouring agents, suspending agents, thickening agents, colours, viscosity regulators, stabilizers or osmo-regulators. Suitable examples of liquid vehicles for oral and enteral administration include water (partially containing additives as above, e.g. cellulose derivatives, preferably sodium carboxymethyl cellulose solution), alcohols (including monohydric alcohols and polyhydric alcohols, e.g. glycols) and their derivatives, and oils (e.g. fractionated coconut oil and *arachis* oil). For parenteral administration, the vehicle can also be an oily ester such as ethyl oleate and isopropyl myristate. Sterile liquid vehicles are useful in sterile liquid form compositions for enteral administration. The liquid vehicle for pressurized compositions can be a halogenated hydrocarbon or other pharmaceutically acceptable propellant.

For transdermal administration, the pharmaceutical or veterinary composition can be formulated into ointment, cream or gel form and appropriate penetrants or detergents could be used to facilitate permeation, such as dimethyl sulfoxide, dimethyl acetamide and dimethylformamide.

For transmucosal administration, nasal sprays, rectal or vaginal suppositories can be used. The active compounds can be incorporated into any of the known suppository bases by methods known in the art. Examples of such bases include cocoa butter, polyethylene glycols (carbowaxes), polyethylene sorbitan monostearate, and mixtures of these with other compatible materials to modify the melting point or dissolution rate.

The present invention relates to a method for treating a disease or disorder caused by bacteria comprising administering a therapeutically amount of the pharmaceutical or veterinary composition as disclosed herein to a subject having such disease or disorder and in need of treatment. It also relates to the pharmaceutical or veterinary composition as disclosed herein for use in the treatment of a disease or disorder caused by bacteria. It further relates to the use of a pharmaceutical or veterinary composition as disclosed herein for the manufacture of a medicament for treating a disease or disorder caused by bacteria.

The diseases or disorders caused by bacteria may be selected from the group consisting of abdominal cramps, acne vulgaris, acute epiglottitis, arthritis, bacteraemia, bloody diarrhea, botulism, Brucellosis, brain abscess, chancroid venereal disease, *Chlamydia*, Crohn's disease, conjunctivitis, cholecystitis, colorectal cancer, polyposis, dysbiosis, Lyme disease, diarrhea, diphtheria, duodenal ulcers, endocarditis, erysipelothricosis, enteric fever, fever, glomerulonephritis, gastroenteritis, gastric ulcers, Guillain-Barre syndrome tetanus, gonorrhoea, gingivitis, inflammatory bowel diseases, irritable bowel syndrome, leptospirosis, leprosy, listeriosis, tuberculosis, Lady Widermere syndrome, Legionaire's disease, meningitis, mucopurulent conjunctivitis, multi-drug resistant bacterial infections, multi-drug resistant bacterial carriage, myonecrosis-gas gangrene, *Mycobacterium avium* complex, neonatal necrotizing enterocolitis, nocardiosis, nosocomial infection, otitis, periodontitis, phalyngitis, pneumonia, peritonitis, purpuric fever, Rocky Mountain spotted fever, shigellosis, syphilis, sinusitis, sigmoiditis, septicaemia, subcutaneous abscesses, tularaemia, tracheobronchitis, tonsillitis, typhoid fever, ulcerative colitis, urinary infection and whooping cough.

The disease or disorder caused by bacteria may be a bacterial infection selected from the group consisting of skin infections such as acne, intestinal infections such as esophagitis, gastritis, enteritis, colitis, sigmoiditis, rectitis, and peritonitis, urinary tract infections, vaginal infections, female upper genital tract infections such as salpingitis, endometritis, oophoritis, myometritis, parametritis and infection in the pelvic peritoneum, respiratory tract infections such as pneumonia, intra-amniotic infections, odontogenic infections, endodontic infections, fibrosis, meningitis, bloodstream infections, nosocomial infection such as catheter-related infections, hospital acquired pneumonia, post-partum infection, hospital acquired gastroenteritis, hospital acquired urinary tract infections, and a combination thereof. Preferably, the infection according to the disclosure is caused by a bacterium presenting an antibiotic resistance. In a particular embodiment, the infection is caused by a bacterium as listed above in the targeted bacteria.

The disease or disorder caused by bacteria may also be a metabolic disorder, for example, obesity and diabetes. The disclosure thus also concerns a pharmaceutical or veterinary composition as disclosed herein for use in the treatment of metabolic disorder including, for example, obesity and diabetes. It further concerns a method for treating a metabolic disorder comprising administering a therapeutically amount of the pharmaceutical or veterinary composition as disclosed herein, and the use of a pharmaceutical or veterinary composition as disclosed herein for the manufacture of a medicament for treating a metabolic disorder.

The disease or disorder caused by bacteria may also be a pathology involving bacteria of the human microbiome. Thus, in a particular embodiment, the disclosure concerns a pharmaceutical or veterinary composition as disclosed herein for use in the treatment of pathologies involving bacteria of the human microbiome, such as inflammatory and auto-immune diseases, cancers, infections or brain disorders. It further concerns a method for treating a pathology involving bacteria of the human microbiome comprising administering a therapeutically amount of the pharmaceutical or veterinary composition as disclosed herein, and the use of a pharmaceutical or veterinary composition as disclosed herein for the manufacture of a medicament for treating a pathology involving bacteria of the human microbiome. Indeed, some bacteria of the microbiome, without triggering any infection, can secrete molecules that will induce and/or enhance inflammatory or auto-immune diseases or cancer development. More specifically, the present disclosure relates also to modulating microbiome composition to improve the efficacy of immunotherapies based, for example, on CAR-T (Chimeric Antigen Receptor T) cells, TIL (Tumor Infiltrating Lymphocytes) and Tregs (Regulatory T cells) also known as suppressor T cells. Modulation of the microbiome composition to improve the efficacy of immunotherapies may also include the use of immune checkpoint inhibitors well known in the art such as, without limitation, PD-1 (programmed cell death protein 1) inhibitor, PD-L1 (programmed death ligand 1) inhibitor and CTLA-4 (cytotoxic T lymphocyte associated protein 4).

Some bacteria of the microbiome can also secrete molecules that will affect the brain.

Therefore, a further object of the disclosure is a method for controlling the microbiome of a subject, comprising administering an effective amount of the pharmaceutical composition as disclosed herein in said subject.

In a particular embodiment, the disclosure also relates to a method for personalized treatment for an individual in need of treatment for a bacterial infection comprising: i) obtaining a biological sample from the individual and determining a group of bacterial DNA sequences from the sample; ii) based on the determining of the sequences, identifying one or more pathogenic bacterial strains or species that were in the sample; and iii) administering to the individual a pharmaceutical composition according to the disclosure capable of recognizing each pathogenic bacterial strain or species identified in the sample and to deliver the packaged plasmid.

Preferably, the biological sample comprises pathological and non-pathological bacterial species, and subsequent to administering the pharmaceutical or veterinary composition according to the disclosure to the individual, the amount of pathogenic bacteria on or in the individual are reduced, but the amount of non-pathogenic bacteria is not reduced.

In another particular embodiment, the disclosure concerns a pharmaceutical or veterinary composition according to the disclosure for use in order to improve the effectiveness of drugs. Indeed, some bacteria of the microbiome, without being pathogenic by themselves, are known to be able to metabolize drugs and to modify them in ineffective or harmful molecules.

In another particular embodiment, the disclosure concerns a composition according to the invention that may further comprise at least one additional active ingredient, for instance a prebiotic and/or a probiotic and/or an antibiotic, and/or another antibacterial or antibiofilm agent, and/or any agent enhancing the targeting of the bacterial delivery vehicle to a bacteria and/or the delivery of the payload into a bacteria.

In another particular embodiment, the disclosure concerns the in-situ bacterial production of any compound of interest, including therapeutic compound such as prophylactic and therapeutic vaccine for mammals. The compound of interest can be produced inside the targeted bacteria, secreted from the targeted bacteria or expressed on the surface of the targeted bacteria. In a more particular embodiment, an antigen is expressed on the surface of the targeted bacteria for prophylactic and/or therapeutic vaccination.

The present disclosure also relates to a non-therapeutic use of the bacterial delivery particles. For instance, the non-therapeutic use can be a cosmetic use or a use for improving the well-being of a subject, in particular a subject who does not suffer from a disease, and in particular from a disease or disorder caused by bacteria. Accordingly, the present disclosure also relates to a cosmetic composition or a non-therapeutic composition comprising the bacterial delivery particles of the disclosure.

EXAMPLE 1

The example below demonstrates that a significative portion of a lambda receptor binding protein (RBP), e.g. the stf protein, can be exchanged with a portion of a different RBP. More particularly, specific fusion positions in the lambda RBP have been identified which allow one to obtain a functional chimeric RBP. Specifically, the data demonstrate in a non-limiting embodiment that in the case of packaged phagemids derived from bacteriophage lambda, modifying the side tail fiber protein results in an expanded host range. The addition of chimeric stf proteins to lambdoid packaged phagemids, is demonstrated to be a very powerful approach to modify and increase their host range, and in some cases is more efficient than the modification of the gpJ gene. In addition, modification of the side tail fiber protein to encode enzymatic activity such as depolymerase activities can dramatically increase the delivery efficiency. In some cases, the addition of this enzymatic activity allows for 100% delivery efficiency while the wild-type lambda packaged phagemid showed no entry at all. These two approaches can be combined to generate packaged phagemid variants with different specificities and delivery efficiencies to many strains of bacterial species.

Materials and Methods

Tests were conducted to determine whether the modification of the tail tip gene (gpJ) would have an impact in the host range of lambda packaged phagemids. The lambda tail tip was modified to include the mutations described in [11] to generate OMPF-lambda. This packaged phagemid should now use OmpF instead of LamB as a primary receptor in the cell surface. Next, the delivery efficiency was tested in a collection of E. coli strains that spans a variety of O and K serotypes, as shown in FIG. 1.

As can be seen in FIG. 1, using packaged phagemids that recognize a different cell surface receptor has a minimal impact on efficiency delivery and host range. Only 3 strains show a marginal improvement in the number of colonies after treatment with the modified packaged phagemid. This result may be due to the presence of a capsule around the majority of the cells that forms a physical barrier to the packaged phagemids, thus rendering this approach unsuccessful. In view of these results, the lambda stf gene was modified to include enzymatic activities against bacterial capsules.

The sequence of lambda stf (SEQ ID NO:1) is:

MAVKISGVLKDGTGKPVQNCTIQLKARRNSTTVVVNTVGSENPDEAGRYS

MDVEYGQYSVILQVDGFPPSHAGTITVYEDSQPGTLNDFLCAMTEDDARP

EVLRRLELMVEEVARNASVVAQSTADAKKSAGDASASAAQVAALVTDATD

SARAASTSAGQAASSAQEASSGAEAASAKATEAEKSAAAAESSKNAAATS

AGAAKTSETNAAASQQSAATSASTAATKASEAATSARDAVASKEAAKSSE

TNASSSAGRAASSATAAENSARAAKTSETNARSSETAAERSASAAADAKT

AAAGSASTASTKATEAAGSAVSASQSKSAAEAAAIRAKNSAKRAEDIASA

VALEDADTTRKGIVQLSSATNSTSETLAATPKAVKVVMDETNRKAPLDSP

ALTGTPTAPTALRGTNNTQIANTAFVLAAIADVIDASPDALNTLNELAAA

LGNDPDFATTMTNALAGKQPKNATLTALAGLSTAKNKLPYFAENDAASLT

ELTQVGRDILAKNSVADVLEYLGAGENSAFPAGAPIPWPSDIVPSGYVLM

QGQAFDKSAYPKLAVAYPSGVLPDMRGWTIKGKPASGRAVLSQEQDGIKS

HTHSASASGTDLGTKTTSSFDYGTKTTGSFDYGTKSTNNTGAHAHSLSGS

TGAAGAHAHTSGLRMNSSGWSQYGTATITGSLSTVKGTSTQGIAYLSKTD

SQGSHSHSLSGTAVSAGAHAHTVGIGAHQHPVVIGAHAHSFSIGSHGHTI

TVNAAGNAENTVKNIAFNYIVRLA

The bold and underlined sequence represents the part of the protein that was introduced in the T4 phage (Montag et al. J Bacteriol. 1989 August; 171(8): 4378-4384). Experiments were conducted to investigate if it was possible to exchange the C-terminus of the lambda stf with a tail fiber from a different phage to yield chimeric side tail fibers with an enzymatic activity against encapsulated E. coli. The tail fiber from the K1F phage which has been studied in depth and its structure solved [19], [20] was chosen. K1F encodes an enzyme with endosialidase activity, which is active against polymer of sialic acid secreted by K1-encapsulated E. coli. In fact, K1+ strains are immune to T7 infection because the capsule forms a physical barrier that prevents attachment of the phage, but if purified K1F enzyme is added to the cells before infection, T7 is able to lyse them [21], confirming that the presence of bacterial capsules is a powerful mechanism to avoid recognition by bacteriophages. Thus, by testing delivery of modified lambda-stf-K1 packaged phagemids in K1+ strains it was possible to verify whether the lambda-stf chimeric proteins retain its enzymatic activity.

The sequence of K1F tail fiber (SEQ ID NO:121) is:

MSTITQFPSGNTQYRIEFDYLARTFVVVTLVNSSNPTLNRVLEVGRDYRF

LNPTMIEMLVDQSGEDIVRIHRQTGTDLVVDFRNGSVLTASDLTTAELQA

IHIAEEGRDQTVDLAKEYADAAGSSAGNAKDSEDEARRIAESIRAAGLIG

YMTRRSFEKGYNVTTWSEVLLWEEDGDYYRWDGTLPKNVPAGSTPETSGG

IGLGAWVSVGDAALRSQISNPEGAILYPELHRARWLDEKDARGWGAKGDV

TDDTAALTSALNDTPVGQKINGNGKTYKVTSLPDISRFINTRFVYERGIP

GQPLYYASEEFVQGELFKITDTPYYNAWPQDKAFVYENVIVAPYMGSDRH

GVSRLHVSWVKSGDDGQTWSTPEWLTDLHPDYPTVNYHCMSMGVCRNRLF

AMIETRTLAKNALTNCALWDRPMSRSLHLTGGITKAANQRVATIHVPDHG

LFVGDFVNFSNSAVTGVSGDMTVATVIDKDNFTVLTPNQQTSDLNNAGKN

WHMGTSFHKSPWRKTDLGLIPSVTEVHSFATIDNNGFAMGYHQGDVAPRE

VGLFVFPDAFNSPSNYVRRQIPSEYEPDASEPCIKYYDGVLYLITRGTRG

DRLGSSLHRSRDIGQTWESLRFPHNVHHTTLPFAKVGDDLIMFGSERAEN

-continued

EWEAGAPDDRYKASYPRTFYARLNVNNWNADDIEWVNITDQIYQGGIVNS

GVGVGSVVVKDNYIYYMFGGEDHFNPWTYGDNSAKDPFKSDGHPSDLYCY

KMKIGPDNRVSRDFRYGAVPNRAVPVFFDTNGVRTVPAPMEFTGDLGLGH

VTIRASTSSNIRSEVLMEGEYGFIGKSIPTDNPAGQRHFCGGEGTSSTTG

AQITLYGANNTDSRRIVYNGDEHLFQSADVKPYNDNVTALGGPSNRFTTA

YLGSNPIVTSNGERKTEPVVFDDAFLDAWGDVHYIMYQWLDAVQLKGNDA

RIHFGVIAQQIRDVFIAHGLMDENSTNCRYAVLCYDKYPRMTDTVFSHNE

IVEHTDEEGNVTTTEEPVYTEVVIHEEGEEWGVRPDGIFFAEAAYQRRKL

ERIEARLSALEQK

The bold and underlined sequence represents the part of the protein that has been crystalized and has been shown to retain its endosialidase activity. Since there is no identity between the lambda stf protein and the K1F tail fiber, the insertion site was made based on conclusions extracted from different sources of information, including literature and crystal structures.

The stf gene was modified to include the K1F endosialidase at its C-terminus using a Cas9-mediated gene exchange protocol [22] and resulted in a lambda-K1F chimeric stf of nucleotide sequence SEQ ID NO: 106 and aminoacid sequence SEQ ID NO: 46. Lambda-K1F phagemids were produced as in [23] and titrated against some K1+ strains, specifically E. coli UTI89 and S88. The results were striking; in these strains, there is no delivery if lambda wild-type stf is used, but the addition of the lambda-K1F variant of SEQ ID NO: 46 to the packaged phagemid gives 100% delivery (FIG. 2).

The same principle was followed to create a different variant of lambda-stf, this time with K5-capsule degrading activity (K5 lyase tail fiber from phage K5A). As in the case of K1F, there is no homology between lambda-stf and K5 lyase, but its crystal structure has been published [24]. Hence, the same approach as for K1F was used to generate lambda-K5 chimeric side tail fibers of nucleotide sequence SEQ ID NO: 107 and aminoacid sequence SEQ ID NO: 47 and tested the produced packaged phagemids against a K5-encapsulated strain of E. coli (ECOR 55). In this case, however, a delta-stf lambda production strain was produced with the lambda-K5 stf fusion gene expressed in trans under the control of an inducible promoter. As depicted in FIG. 3, there was some residual delivery using the wild-type lambda-stf, probably due to the presence of some cells with a thinner K5 capsule. However, the addition of lambda-stf-K5 chimeras allows for an improvement in delivery of more than $10^6$ fold.

In some other cases, side tail fibers can be found that have some degree of homology to lambda stf, although no crystal structure is available. In these cases, the insertion site was designed as the last stretch of amino acids with identity to lambda stf. For example, in two in-house sequenced phages, the predicted side tail fiber proteins are as follows:

Phage AG22 stf:
MAIYRQGQASMDAQGYVTGYGTKWREQLTLIRP-GATIFFLAQPLQAAVITEVISD TSIRAITTGGAVVQKT-NYLILLHDSLTVDGLAQDVAETLRYYQGKESEFAG-FIEIIKDFD WDKLQKIQEDVKTNADAAAASQQAAK-TSENNAKTSATNAANSKKGADTAKAAAESA RDAA-NTAKTGAEAAKSGAESARDAANTAKAGAESARDQ-AEEYAKQAAEPYKDLLQPL PDVWIPFNDSLDMITGF-SPSYKKIVIGDDEITMPGDKIVKFKRASTATYINK-SGVLTNAAI DEPRFEKDGLLIEGQRTNLLINSTNP-SKWNKSSNMILDRSGVDDFGFQYAKFTLKPEMV GQTSSINIVTVSGSRGFDVTGNEKYVTISCRAQSGTP-NLRCRLRFENYDGSAYASLGDAY VNLTDLSIEKTG-GAANRITARAVKDEASKWIFFEATIKALDTENMIG-AMVQYAPAKDGG GTGADDYIYIATPQVEGGVCASS-FIITEATPVTRASDMVTIPIKNNLYNLPFTVLCEVHKN WYITPNAAPRVFDTGGHQSGAAIILAFGSADGDND-GFPYCDIGKSNRRVNENAKLKKMI IGMRVKSDYN-TCCVSNARISSETKTEWRYIVSTATIRIGGQTSTGER-HLFGHVRNFRIWH KALTDHQLGEIV (SEQ ID NO:204) and corresponding nucleotide sequence of SEQ ID NO: 213.

Its alignment to lambda stf is as follows:

```
Lambda 156   STSAGQAASSAQEASSGAEAASAKATEAEKSAAAAESSKNAAATSAGAAKTSETNAAASQ

AG22    92   ETLRYYQGKESEFAGPIEIIKDPDWDKLQKIQEDVKTNADAAAASQQAAKTSENNAKTSA
              *          *              *       *** * ****** ** *
```

The sequence of the stf of a second in-house phage is as follows:

Phage SIEA11 stf:
MSTKFKTVITTAGAAKLAAATVPGGKKVTLSA-MAVGDGNGKLPVPDAGQTKLV HEVWRHALNKVS-VDNKNKNYIVAELVVPPEVGGFWMRELGLYDD-AGTLIAVSNMAES YKPELAEGSGRAQTCRMVIIVSN-VASVELSIDASTVMATQDYVDDKIAEHEQSRRHPDA TLTEKGFTQLSSATNSTSESLAATPKAVKAANDNAN-SRLAKNQNGADIQDKSAFLDNV GVTSLTFMKNN-GEMPVDADLNTFGSVKAYSGIWSKATSTNATLEK-NFPEDNAVGVLEV FTGGNFAGTQRYTTRDGNLYIR-KLIGTWNGNDGPWGAWRHVQAVTRALSTTIDLN-SLG GAEHLGLWRNSSSAIASFERHYPEQGGDAQGIL-EIFEGGLYGRTQRYTTRNGTMYIRGLT AKWDAEN-PQWEDWNQIGYQTSSTFYEDDLDDLMSPGIYSVTG-KATHTPIQGQSGFLEVI RRKDGVYVLQRYTTTGT-SAATKDRLYERVFLGGSFNAWGEWRQIYNSNSLP-LELGIGG AVAKLTSLDWQTYDFVPGSLITVRLDNMT-NIPDGMDWGVIDGNLINISVGPSDDSGSGR SMHVW-RSTVSKANYRFFMVRISGNPGSRTITTRRVPIIDEA-QTWGAKQTFSAGLSGELSG NAATATKLKTARKIN-NVSFDGTSDINLTPKNIGAFASGKTGDTVANDKAVG-WNWSSGA YNATIGGASTLILHFNIGEGSCPAAQFRV-NYKNGGIFYRSARDGYGFEADWSEFYTTTRK PTAG-DVGALPLSGGQLNGALGIGTSSALGGNSIVLGDN-DTGFKQNGDGNLDVYANSVH VMRFVSGSVQSNK-TINITGRVNPSDYGNFDSRYVRDVRLGTRVVQ-TMQKGVMYEKAG HVITGLGIVGEVDGDDPAVFR-PIQKYINGTWYNVAQV (SEQ ID NO:205) and corresponding nucleotide sequence of SEQ ID NO: 214.

Its alignment to lambda stf is as follows:

```
Lambda  367  SSATNSTSETLAATPKAVKVVMDETNRKAPLDSPALTGTPTAPTALRGTNNTQIANTAFV

SIEA11  180  SSATNSTSESLAATPKAVKAANDNANSRL---AKNQNGADIQDKSAF-LDNVGVTSLTFM
             ********* *********  *  *        *              *        *
```

In these two specific cases, it was unknown which antigen these side tail fibers were able to recognize, so lambda packaged phagemids with the chimeric side tail fibers lambda-AG22 and lambda-SIEA11 engineered based respectively on SEQ ID NO: 1 and SEQ ID NO: 213, and SEQ ID NO: 1 and SEQ ID NO: 214 were produced and their delivery efficiency was tested in a *E. coli* collection that contains a very diverse group of O and K serotypes.

As shown in FIG. 4, the addition of a chimeric stf allows the lambda-based packaged phagemid to show increased delivery efficiency in 25 out of 96 strains tested (more than 25% of the collection). In some cases, the increase is modest; in others, it allows for very good delivery efficiency in strains that had no or very low entry with wild-type lambda packaged phagemids. It is also worth noting that AG22 belongs to the Siphovirus family, like lambda, but SIEA11 is a P2-like phage. This highlights the significant observation that stf modules can be exchanged across bacteriophage genera.

Other side tail fiber genes have been analyzed as shown in FIG. 4 and several insertion sites into the lambda stf gene have been identified that give chimeric variants with differential entry in the *E. coli* collection as shown previously. These insertion sites are based on the results for the non-homologous tail fiber variants (such as in the cases for K1F and K5 above) or on varying degrees of homology between lambda stf and the variant to be tested. This homology can be short, about 5-10 aminoacids, or substantially similar. The insertion sites tested are shown in bold and underlined below:

```
lambda stf
                                           (SEQ ID NO: 1)
MAVKISGVLKDGTGKPVQNCTIQLKARRNSTTVVVNTVGSENPDEAGRYS

MDVEYGQYSVILQVDGFPPSHAGTITVYEDSQPGTLNDFLCAMTEDDARP

EVLRRLELMVEEVARNASVVAQSTADAKKSAGDASASAAQVAALVTDATD

SARAASTSAGQAASSAQEASSGAEAASAKATEAEKSAAAAESSKNAAATS

AGAAKTSETNAAASQQSAATSASTAATKASEAATSARDAVASKEAAKSSE

TNASSSAGRAASSATAAENSARAAKTSETNARSSETAAERSASAAADAKT

AAAGSASTASTKATEAAGSAVSASQSKSAAEAAAIRAKNSAKRAEDIASA

VALEDADTTRKGIVQLSSATNSTSETLAATPKAVKVVMDETNRKAPLDSP

ALTGTPTAPTALRGTNNTQIANTAFVLAAIADVIDASPDALNTLNELAAA

LGNDPDFATTMTNALAGKQPKNATLTALAGLSTAKNKLPYFAENDAASLT

ELTQVGRDILAKNSVADVLEYLGAGENSAFPAGAPIPWPSDIVPSGYVLM

QGQAFDKSAYPKLAVAYPSGVLPDMRGWTIKGKPASGRAVLSQEQDGIKS

HTHSASASGTDLGTKTTSSFDYGTKTTGSFDYGTKSTNNTGAHAHSLSGS

TGAAGAHAHTSGLRMNSSGWSQYGTATITGSLSTVKGTSTQGIAYLSKTD
```

-continued
```
SQGSHSHSLSGTAVSAGAHAHTVGIGAHQHPVVIGAHAHSFSIGSHGHTI

TVNAAGNAENTVKNIAFNYIVRLA
```

The lambda stf protein consists of 774 aminoacids. The insertion sites can be found closer to the N-terminus (amino acid 131, insertion point ADAKKS (SEQ ID NO: 191)) or closer to the C-terminus (amino acid 529, insertion point GAGENS (SEQ ID NO:194)). Stf chimeras with aminoacid sequences of SEQ ID NO: 2-45 and 48-61 and corresponding nucleotide sequences of SEQ ID NO: 62-105 and 108-120 were engineered using these insertion sites. FIG. 5 depicts some selected examples for the insertion points ADAKKS (SEQ ID NO: 191), SASAAA (SEQ ID NO: 193) and MDETNR (SEQ ID NO: 192). The results described herein show that it is possible to build chimeric tail fibers that combine the part of one tail fiber that attaches to the capsid of one phage (usually the N-terminus of the protein) with the part of another fiber that interacts with the bacterium (usually the C-terminus of the protein). Stretches of homology between the sequences of different tail fibers can be considered as preferable recombination sites. In order to identify such sites for the stf protein of phage lambda a scan of the Stf sequence was performed with a 50aa window and a phmmer search [25] was performed on each window to identify homologous sequences in the representative proteome 75 database (FIG. 6).

EXAMPLE 2

Many phages contain a single stf protein, which is a very important factor determining their host specificity. However, there are also several examples of phages encoding more than one stf gene, which is a beneficial trait since, presumably, each of them recognizes a different host. These phages have found different solutions to achieve this feature: some of them, like phi92, encode up to 6 stfs that bind to different parts of the baseplate/viral particle, and probably to other stfs [29]; others, like CBA120 [30], encode 4 stfs that form a tetrameric structure in which one of the stfs attaches to the phage particle while the other three attach to the first one through interaction; and others, like DT57C, contain an stf that binds the particle and a second one that attaches to the first through an interaction domain (branched stfs) [32] (FIG. 7A). In terms of engineering, having a particle that is able to recognize different hosts could have a great impact in terms of production costs and host range expansion.

As a proof of concept, an engineered lambda stf was constructed based on a branched architecture. A phage, referred to as WW11, contains two stfs of SEQ ID NO: 124 and 125 that follow the same order and contain homology to phage DT57C, which has been suggested to have branched stfs. The interaction domains of stf-1 and stf-2 in phage WW11 have been identified and used as modules to attach to the Lambda stf. The final construct contains the N-terminal part of the lambda stf of SEQ ID NO: 1 up to the GAGENS insertion site SEQ ID NO: 194 fused to WW11 stf-1 interaction domain ID1 of SEQ ID NO: 280 and WW11 stf-1 proper; after this, a synthetic RBS was inserted and immediately after, the stf-2 interaction domain ID2 of SEQ ID NO: 281 was fused to the C-terminal part of the K1F tail fiber of SEQ ID NO: 121 (see bold sequence of section [198] (FIG. 7B). The GAGENS insertion site of SEQ ID NO: 194 was chosen as the insertion site. Both chimeric proteins were transcribed from a polycistronic mRNA. This construction resulted in a final branched stf WW11-K1F of aminoacid sequence SEQ ID NO: 282 and SEQ ID NO: 283 expressed from nucleotide sequence of SEQ ID NO: 284.

The original host range of WW11 phage is O157 strains, while that of K1F phage is K1 strains. As demonstrated in FIG. 8, when producing packaged phagemids containing the branched chimeric stf of SEQ ID NO: 282 and SEQ ID NO: 283, it can be seen that the host range of the branched stf is now the combination of each single stf, i.e. a combination of both single stf activities (O157 and K1). Although the K1F stf in the branched architecture seems to be less efficient than in the particle containing only one stf, further engineering such as, for example, (i) choosing a more efficient RBS between both stfs, (ii) increasing the length or (iii) introducing flexible linkers between the interaction domains and the fusion stfs and/or (iv) increasing the translation rate of the first stf in the polycistron (since this is known to affect the translation rate of the second CDS in a polycistronic message). An advantage of this approach is also that the stfs are present in the phagemid particle in a 1:1 ratio, assuming proper expression of both components, which may be important for regulatory purposes.

Following a similar approach to the "dimeric" branched stf (Lambda-ID1-WW11 ID2-K1F), a lambda particle whose stf carried 4 different activities was designed. CBA120 is a phage with 4 fibers (called stf; See, FIG. 9). Their sequences are below: Stf4 (also called TSP4) of FIG. 9 (orf213, protein ID YP_004957867.1) (SEQ ID NO:127), stf3 (also called TSP1) of FIG. 9 (orf212, protein ID YP_004957866.1) (SEQ ID NO:128), stf2 (also called TSP2) of FIG. 9 (orf211, protein ID YP_004957865.1) (SEQ ID NO: 129), and stf1 (also called TSP1) of FIG. 9 (orf210, protein ID YP_004957864.1) (SEQ ID NO: 130). During analysis of these 4 TSPs, it was noticed that the N-termini have homology to phages G7C/WW11/DT57C, which is a strong indication that these stfs associate to form a tetrameric complex. The first stf to be translated, according to the TSP operon in the CBA120 genome, is TSP4, then TSP3, then TSP2, then TSP1. From this information, it was assumed that the main stf is TSP4, since it's the one to be expressed first. It may encode an ID domain to which more than one TSP attaches. The N-terminal domains also share homology to one another, which helps in the identification of the presumable ID domains. The following interaction domains (ID) were found with probable branching/association activities, making BLAST analysis to the phages mentioned above: TSP4 ID4 Of FIG. 9 (SEQ ID NO: 131) (ID4 seems to have an extra domain at the N-terminus that may be involved in capsid binding, so it will be left out of the final construct), TSP3 ID3 of FIG. 9 (SEQ ID NO: 132), TSP2 ID2 of FIG. 9 (SEQ ID NO: 133), and TSP1 ID1 of FIG. 9 (SEQ ID NO:134).

The following describes the assembly process to be used to construct the tetrameric branched RBP. First, the domains were recoded and two gene blocks were ordered. Recoding is a very common process, and the objective is two-fold. First recoding is done to avoid codon bias based on the fact that the codons used for a given amino acid vary depending on the organism. Accordingly, to avoid expression problems, which can lead to truncated, mutated or misfolded proteins, sequences were recoded with the codon usage of the host organism (in this case *E. coli*). Second, removal of unknown layers of regulation may be advantageous. This is especially true for operons, phages and in general any other sequences with high "density information", like a phage genome; they have a limited amount of DNA that can be packaged, so several signals and functions may be encoded within a region, and this may impact the ability to use a genetic part in the desired way.

Plasmid pPh1F-Tetra STF BsaI cloning (pSC101 37C, KanR) has been cloned, containing a fusion to Lambda stf GAGENS of SEQ ID NO: 194 with TSP4 interaction domain (SEQ ID NO: 131). The other TSP interaction domains are preceded by a synthetic RBS to avoid including unknown layers of regulation from the phage. This plasmid allows the TypeIIS cloning (BSaI) of 4 stfs fused to each of the TSP interaction domains. Four stfs and 4 strains were identified for readout of each stf activity: (i)—V10: strain V10; (ii)—K1F: strain K1F; (iii)—K5: strain K5; and—stf48: strain 48. These four stfs will be cloned as fusions with ID4 of SEQ ID NO: 131, ID3 of SEQ ID NO: 132, ID2 of SEQ ID NO: 133 and ID1 of SEQ ID NO: 134, respectively. ID4 is fused to the N-terminus of Lambda stf at the GAGENS SEQ ID NO: 194 insertion site (FIG. 9A-B). The final architecture for expression of the tetrameric is depicted in FIG. 9B, although such an expression scheme may be modified, since the plasmid will be large (>16 kb) and the length of the transcribed mRNA is >9 kb.

EXAMPLE 3

T4-like phages are a very diverse family of bacteriophages that share a common long tail fiber architecture: a proximal tail fiber that attaches to the phage particle and a distal tail fiber (DTF) that encodes host specificity linked by proteins acting as "hinge connectors" (Desplats and Krisch, 2003, Res. Microbiol. 154:259-267; Bartual et al. 2010, Proc. Natl. Acad. Sci. 107: 20287-20292). It is thought that the main host range determinants of the tail fiber reside in the distal part. Hence, it is very important to understand if it is possible to translate the host range of a given T4-like phage, which are known to be very broad, to any other phage or packaged phagemid of interest. The distal tail fiber (C-terminal domain of the T4-like long tail fiber) of several T4-like phages were screened for possible functional insertion sites, several fusions with the Lambda stf gene were generated and their host range screened.

Possible insertion sites in the DTF that, when fused to a heterologous tail fiber (the lambda phage stf), will give a functional chimera were searched. The DTF of the phage (WW13) was used as a testbed. This phage possesses a classical T4-like architecture, with a proximal and a distal tail fiber separated by hinge connectors, a gp38 chaperone/adhesin (to assist folding of the tail fiber and recognition of the host (Trojet et al., 2011, Genome Biol. Evol. 3:674-686) and a gp57A chaperone known to be needed for proper folding of the tail fiber (Matsui et al., 1997, J. Bacteriol. 179:1846-1851). Since the endogenous genomic regulation of T4-like phages is complex and may include unknown layers of regulation (Miller et al., 2003, Microbio. Mol. Biol. Rev. 67:86-156), a synthetic linker encoding a RBS was designed to replace the natural DNA linker between the DTF gene and the adhesin; immediately downstream, another synthetic RBS preceding the chaperone gp57A was added, hence creating a polycistronic mRNA encoding for all the functions needed for the proper folding of the DTF (FIG. 10). This construct was built in a plasmid under the control of an inducible promoter and complemented in trans in a strain producing lambda-based phagemids.

FIG. 10. depicts the architecture of an engineered lambda stf-T4-like DTF chimera. The semicircles denote RBS sites; the T sign, a transcriptional terminator; the arrow, a promoter. Several parts of the C-terminus of the DTF were screened and fused to the lambda stf gene at the GAGENS (SEQ ID NO: 194) insertion site. Several variants of the chimera lambda stf-WW13 were functional, as assessed by production of phagemid particles and transduction of a chloramphenicol marker in a collection of E. coli strains. The functional chimeras shown in FIG. 11 were obtained with fusion at the IIQLED (SEQ ID NO:196) insertion site in WW13. Additional functional chimeras were obtained by fusion at the lambda stf MDETNR (SEQ ID NO: 192) insertion site and at the WW13 DTF GNIIDL (SEQ ID NO: 197), VDRAV (SEQ ID NO:203) and IIQLED (SEQ ID NO:196) insertion sites (FIG. 13)

Other T4-like phages, like PP-1, sharing sequence homology with WW13 were also tested and verified to produce functional chimeras (FIG. 11). These functional chimeras show a IATRV (SEQ ID NO: 198) insertion site at the beginning of PP-1 DTF part.

FIG. 11 depicts screening of phagemid particles with chimeric lambda stf-T4-like DTFs and in particular chimeric lambda stf-WW13 and chimeric lambda stf-PP1 of aminoacids sequences SEQ ID NO: 142 to 149 and nucleotide sequences of SEQ ID NO: 166 to 173 including their respective chaperones proteins. A collection of 96 different wild type E. coli strains, encompassing different serotypes, was transduced with lambda-based packaged phagemids and plated on Cm LB agar. Left panel represents wild-type lambda stf; the middle panel represents chimeric lambda-stf-WW13; and the right panel, represents chimeric lambda-stf-PP-1.

The insertion sites found for WW13 do not always exist in a given T4-like DTF, thereby complicating the analysis. Another functional insertion site without homology to WW13 was discovered for a second phage (WW55, FIG. 12). The same TPGEL (SEQ ID NO: 199) insertion site could be found in a subset of T4-like phages and proven to yield functional chimeras with at least one of them, WW34 (FIG. 12), and at MDETNR (SEQ ID NO: 192) insertion site in lambda stf.

FIG. 12. shows screening of phagemid particles with chimeric lambda stf-T4-like DTFs and in particular chimeric lambda stf-WW55 and chimeric lambda stf-WW34 of aminoacids sequences SEQ ID NO: 150 to 156 and nucleotide sequences of SEQ ID NO: 174 to 180 including their respective chaperones proteins. A collection of 96 different wild type E. coli strains, encompassing different serotypes, was transduced with lambda-based phagemids and plated on Cm LB agar. The left panel represents wild-type lambda stf; the middle panel represents chimeric lambda-stf-WW55; and the right panel represents chimeric lambda-stf-WW34.

Since T4-like DTF proteins may or may not share common sites for insertion, attempts were made to identify a universal insertion site that exists in all T4-like DTFs. When several T4-like DTFs are aligned, no homology along the whole DTF gene present in all the sequences exists, except for the N-terminus which is well conserved. The N-terminus of the DTF is thought to interact with the hinge connectors for attachment to the main phage particle.

Although the classic view is that the host range determinants reside in the C-terminal part of the DTF, recent studies have proven that the N-terminus may also be involved in this process (Chen et al., 2017, Appl. Environ. Microbiol. VI. 83 No. 23). The N-terminus of the DTF was then scanned to look for an insertion site that exists in all T4-like phages and that is able to yield functional chimeras. Phage WW13 DTF and insertion site MDETNR (SEQ ID NO: 192) in lambda stf were used. While the direct fusion of the complete DTF gene (starting at amino acid 2) gives particles with some activity, a region from amino acid 1 to 90, with a preferred region from amino acid 40 to 50 of the DTF, that recapitulates the behavior of the DTF fusion was identified and is shown in FIG. 13. Importantly, this region exists in all T4-like phages screened and could be very rapidly used to generate chimeras with a diverse set of DTFs, including WW55 (FIG. 13) and in particular chimeric lambda stf-WW14, chimeric lambda stf-WW170 and chimeric lambda stf-202 of aminoacids sequences SEQ ID NO: 157 to 165 and nucleotide sequences of SEQ ID NO: 181 to 189 including their respective chaperones proteins.

Accordingly, the present disclosure is useful for the generation of phage and phagemid particles with altered host ranges, since it provides a practical framework for the construction of chimeras using the DTFs from any T4-like phage, highlighting its modularity and translatability.

EXAMPLE 4

The human microbiome comprises different zones of the body, including gut, skin, vagina and mouth [29]. The microbiota in these areas is composed of different communities of microorganisms, such as bacteria, archaea and fungi [29]-[31]. While numerous studies have been made that try to elucidate the specific composition of these communities, it is becoming clear that while there may exist a "core microbiome", there are many variations in the relative content of each microorganism depending on several factors, such as geographical location, diet or age [32]-[35].

Specifically, in the case of the human gut microbiota, it is not possible to know a priori what are the bacterial species that a given person possesses without running a diagnostic method. In the case of Escherichia coli, some studies have been made that point out to the prevalence of some serotypes and phylogenetic groups in the majority of humans; however, there are significant changes in the composition of the samples depending on the geographic distribution as well as the time of sampling: for example, samples isolated from Europe, Africa, Asia and South America in the 1980s show a prevalence for phylogroups A and B1 (55% and 21%, respectively); but samples obtained in the 2000s in Europe, North America, Asia and Australia belong mainly to the B2 group (43%), followed by the A (24%), D (21%), and B1 (12%) [36]. It is also thought that phylogenetic groups B2 and D are usually more commonly associated with pathogenic strains than with commensal strains [37], but there are studies showing a number of human- and non-human-specific strains belonging to phylogenetic group B2 that are commensals and belong to different serotypes [38].

The intrinsic variability of the human microbiome, and specifically that of Escherichia coli subtypes, makes it difficult to design targeted therapeutic approaches. In the case of phage therapy aimed at killing a target bacterial population, for instance, two possible approaches are possible: first, the use of narrow host range particles that are able to recognize and target a specific E. coli serotype or second the use of broad host range phages that are able to recognize many different strains, sometimes even from different genera [39]. This difficulty is exacerbated if one takes into account strategies that do not aim to kill the target bacterial population, but that seek to add a function to them (i.e. delivery of a factor that will have an effect in the host and that will be expressed by the targeted microbiota). In this specific case, the use of packaged phagemids is of great interest, since they do not kill the host (unless their payload carries genes aimed at killing the host), payload does not replicate and expand and does not contain any endogenous phage genes. However, as in the case of phages, a diagnostic study would be needed to identify the specific serotypes/variants of bacteria that exist in the patient before the treatment in order to find or design a packaged phagemid that allows for delivery of a payload adding a function to the target bacteria without killing them.

By combining these two approaches, it was proposed to use engineered delivery vehicles that are able to recognize a large number of strains belonging to different serotypes and phylogenetic groups (i.e., engineered particles having a "broad host range"), with a focus on *Escherichia coli*. As opposed to a killing-oriented approach, where the targeted bacterial population needs to be as close as possible to 100% to reduce their numbers, a therapeutic delivery approach does not need a priori to reach a large percentage of bacteria; the delivery needs to be high enough for the therapeutic payload to be expressed at the correct levels, which may be highly variable depending on the application. Additionally, the payload can be expressed by different serotypes or phylogenetic groups. This approach increases the chance that the particle will deliver a payload expressed in vivo in the majority of patients.

To achieve the delivery in bacterial communities composed of unknown serotypes/variants of target strains, delivery vehicles were engineered to contain chimeric side tail fibers (stf) that have been selected due to their ability to recognize a large variety of target strains. There are many phages that have been described as having a broad host range in *E. coli* and many of these belong to the T4 family, although in general, phages against *E. coli* and related bacteria have a restricted host range.

However, according to [41], there is no consensus as to how many strains need to be targeted by a phage to be considered as a "broad host range".

In the case of *Escherichia coli*, the ECOR collection is a set of strains isolated from different sources that is thought to represent the variability of this bacterium in Nature [42]. Some phage have been shown to have a broad host range against this collection (for instance, about 53% of the ECOR strains can be lysed with phage AR1 [43] and about 60% with phage SU16 [44]). As opposed to this, a single phage is able to infect 95% of *Staphylococcus aureus* strains [40].

It was decided to use human strains of this collection to test engineered delivery vehicles with chimeric stf and assess their host range in an attempt to identify variants that are able to recognize as many hosts as possible, as has been described in the literature [45]. The difference is that the present assays measure delivery efficiency as opposed to lysis.

Strains from an overnight culture were diluted 1:100 in 600 uL of LB supplemented with 5 mM $CaCl_2$ in deep 96 well plates and grown for 2 hours at 37° C. at 900 rpm. 10 μL of packaged phagemids, containing a DNA payload p7.3 of SEQ ID NO: 277, produced at an average of $10^6$/μL were then added to 90 uL of the bacterial cultures, incubated 30 minutes at 37° C. and 10 μL of the mixtures plated on LB agar supplemented with 24 μg/mL chloramphenicol and incubated overnight at 37° C. The next day, the density of the dots was scored from 0 to 5, with 0 being no transductants and 5 being a spot with very high density [FIG. 14]. The density of the spots is directly related to the delivery efficiency of the packaged phagemids, since it corresponds to the number of bacteria that have received a payload containing a chloramphenicol acetyltransferase gene.

Several stf chimeras were tested and screened in 40 human strains of the ECOR collection. As a control, the delivery efficiency of the wild-type lambda stf of SEQ ID NO: 1 was tested. The packaged phagemid variant used for the delivery experiments was modified so that its tail tip gpJ now recognizes a receptor other than LamB (pgJ A2 variant of aminoacid sequence SEQ ID NO: 278 and nucleotide sequence SEQ ID NO: 279). In FIG. 15-1, FIG. 15-2, FIG. 15-3, the raw dot titrations for 18 chimeric stf of aminoacid sequence of SEQ ID NO: 215 to 242 and nucleotide sequences of SEQ ID NO: 243 to 270 including their respective chaperones proteins are shown and in FIG. 16-1, FIG. 16-2 a bar-formatted table is shown with the delivery efficiencies scored by dot density as well as the delivery statistics.

Taking only into account dots with density scores of 3 and higher (considered as medium to high delivery efficiency), some stf's can be considered as broad host range because the delivery efficiency in the selected ECOR strains is significantly higher than when using the wild type stf. For example, for stf EB6 or stf 68B, about 50% of the strains show medium to high delivery efficiencies, as compared to 17.5% of the strains with the wild type stf. These stf are good candidates for in vivo delivery, since they are able to deliver in different phylogenetic groups as well as serotypes. At the bottom of the Table in FIG. 16-1, FIG. 16-2, a bar-formatted representation for density scores higher than 3 is shown, where the threshold for a broad host range stf is set at an increase of at least 2× compared to the basal line of the wild type stf; this is, stf that are able to deliver with scores of 3 and higher in at least 35% of the strains. Other stf also show an increased delivery as compared to the wild type stf, so a less stringent threshold was set for stf able to deliver with scores 3 or higher with at least a 50% increase compared to the number of strains delivered with the wild-type stf (this is, delivery with scores of 3 and higher in at least 26.25% of the strains). As a comparison, data for stf K1 and stf 66D is shown: these stf seem to be delivering efficiently in a small number of strains (for instance, strains B and AB for stf K1; and strains E and AF for stf 66D), which means that they probably have a narrow host range; this is to be expected, since in the case of the K1 stf the cognate receptor is the K1 capsule [46]. Additionally, data are shown for a chimera with a stf originating in a T4-like phage; as the literature suggests, this chimera shows a broad host range although it does not seem to be the best candidate.

Taken together, these results suggest that the stf of a delivery vehicle can be engineered to recognize a wide number of target *E. coli* strains, hence rendering it "broad host range". This type of particles can be very useful to deliver payloads adding a function to the target bacteria without having to engineer a specific variant that recognizes a given bacterial strain.

LIST OF REFERENCES CITED

Each of the reference cited within the specification and those listed below are hereby incorporated by reference in their entirety.

[1] G. P. C. Salmond and P. C. Fineran, "A century of the phage: past, present and future," *Nat. Rev. Microbiol.*, vol. 13, no. 12, pp. 777-786, December 2015.

[2] P. Hyman and S. T. Abedon, "Bacteriophage host range and bacterial resistance," *Adv. Appl. Microbiol.*, vol. 70, pp. 217-248, 2010.

[3] S. Chatterjee and E. Rothenberg, "Interaction of Bacteriophage λ with Its *E. coli* Receptor, LamB," *Viruses*, vol. 4, no. 11, pp. 3162-3178, November 2012.

[4] Nobrega et al, Nat Rev, 2018 "Targeting mechanisms of tailed bacteriophages"

[5] A. Flayhan, F. Wien, M. Paternostre, P. Boulanger, and C. Breyton, "New insights into pb5, the receptor binding protein of bacteriophage T5, and its interaction with its *Escherichia coli* receptor FhuA," *Biochimie*, vol. 94, no. 9, pp. 1982-1989, September 2012.

[5] M. G. Rossmann, V. V. Mesyanzhinov, F. Arisaka, and P. G. Leiman, "The bacteriophage T4 DNA injection machine," *Curr. Opin. Struct. Biol.*, vol. 14, no. 2, pp. 171-180, April 2004.

[6] Y. Zivanovic et al., "Insights into Bacteriophage T5 Structure from Analysis of Its Morphogenesis Genes and Protein Components," *J. Virol.*, vol. 88, no. 2, pp. 1162-1174, January 2014.

[7] R. W. Hendrix and R. L. Duda, "Bacteriophage lambda PaPa: not the mother of all lambda phages," *Science*, vol. 258, no. 5085, pp. 1145-1148, November 1992.

[8] M. A. Speed, T. Morshead, D. I. Wang, and J. King, "Conformation of P22 tailspike folding and aggregation intermediates probed by monoclonal antibodies," *Protein Sci. Publ. Protein Soc.*, vol. 6, no. 1, pp. 99-108, January 1997.

[9] S. J. Labrie, J. E. Samson, and S. Moineau, "Bacteriophage resistance mechanisms," *Nat. Rev. Microbiol.*, vol. 8, no. 5, pp. 317-327, March 2010.

[10] C. Whitfield, "Biosynthesis and assembly of capsular polysaccharides in *Escherichia coli*," *Annu. Rev. Biochem.*, vol. 75, pp. 39-68, 2006.

[11] J. R. Meyer, D. T. Dobias, J. S. Weitz, J. E. Barrick, R. T. Quick, and R. E. Lenski, "Repeatability and contingency in the evolution of a key innovation in phage lambda," *Science*, vol. 335, no. 6067, pp. 428-432, January 2012.

[12] D. S. Gupta et al., "Coliphage K5, specific for *E. coli* exhibiting the capsular K5 antigen," *FEMS Microbiol. Lett.*, vol. 14, no. 1, pp. 75-78, May 1982.

[13] R. J. Gross, T. Cheasty, and B. Rowe, "Isolation of bacteriophages specific for the K1 polysaccharide antigen of *Escherichia coli*," *J. Clin. Microbiol.*, vol. 6, no. 6, pp. 548-550, December 1977.

[14] D. Schwarzer et al., "A Multivalent Adsorption Apparatus Explains the Broad Host Range of Phage phi92: a Comprehensive Genomic and Structural Analysis," *J. Virol.*, vol. 86, no. 19, pp. 10384-10398, October 2012.

[15] F. Tétart, F. Repoila, C. Monod, and H. M. Krisch, "Bacteriophage T4 host range is expanded by duplications of a small domain of the tail fiber adhesin," *J. Mol. Biol.*, vol. 258, no. 5, pp. 726-731, May 1996.

[16] E. Haggård-Ljungquist, C. Halling, and R. Calendar, "DNA sequences of the tail fiber genes of bacteriophage P2: evidence for horizontal transfer of tail fiber genes among unrelated bacteriophages.," *J. Bacteriol.*, vol. 174, no. 5, pp. 1462-1477, March 1992.

[17] L.-T. Wu, S.-Y. Chang, M.-R. Yen, T.-C. Yang, and Y.-H. Tseng, "Characterization of Extended-Host-Range Pseudo-T-Even Bacteriophage Kpp95 Isolated on *Klebsiella pneumoniae*," *Appl. Environ. Microbiol.*, vol. 73, no. 8, pp. 2532-2540, April 2007.

[18] D. Montag, H. Schwarz, and U. Henning, "A component of the side tail fiber of *Escherichia coli* bacteriophage lambda can functionally replace the receptor-recognizing part of a long tail fiber protein of the unrelated bacteriophage T4," *J. Bacteriol.*, vol. 171, no. 8, pp. 4378-4384, August 1989.

[19] E. R. Vimr, R. D. McCoy, H. F. Vollger, N. C. Wilkison, and F. A. Troy, "Use of prokaryotic-derived probes to identify poly(sialic acid) in neonatal neuronal membranes," *Proc. Natl. Acad. Sci.*, vol. 81, no. 7, pp. 1971-1975, April 1984.

[20] K. Stummeyer, A. Dickmanns, M. Mühlenhoff, R. Gerardy-Schahn, and R. Ficner, "Crystal structure of the polysialic acid-degrading endosialidase of bacteriophage K1F," *Nat. Struct. Mol. Biol.*, vol. 12, no. 1, pp. 90-96, January 2005.

[21] D. Scholl, S. Adhya, and C. Merril, "*Escherichia coli* K1's Capsule Is a Barrier to Bacteriophage T7," *Appl. Environ. Microbiol.*, vol. 71, no. 8, pp. 4872-4874, August 2005.

[22] Y. Jiang, B. Chen, C. Duan, B. Sun, J. Yang, and S. Yang, "Multigene Editing in the *Escherichia coli* Genome via the CRISPR-Cas9 System," *Appl. Environ. Microbiol.*, vol. 81, no. 7, pp. 2506-2514, April 2015.

[23] J. E. Cronan, "Improved Plasmid-Based System for Fully Regulated Off-To-On Gene Expression in *Escherichia coli*: Application to Production of Toxic Proteins," *Plasmid*, vol. 69, no. 1, pp. 81-89, January 2013.

[24] J. E. Thompson et al., "The K5 Lyase KflA Combines a Viral Tail Spike Structure with a Bacterial Polysaccharide Lyase Mechanism," *J. Biol. Chem.*, vol. 285, no. 31, pp. 23963-23969, July 2010.

[25] S. C. Potter, A. Luciani, S. R. Eddy, Y. Park, R. Lopez, and R. D. Finn, "HMMER web server: 2018 update," *Nucleic Acids Res.*, vol. 46, no. W1, pp. W200-W204, July 2018.

[26] E. I. Marusich, L. P. Kurochkina, and V. V. Mesyanzhinov, "Chaperones in bacteriophage T4 assembly," *Biochem. Biokhimiia*, vol. 63, no. 4, pp. 399-406, April 1998.

[27] J. Xu, R. W. Hendrix, and R. L. Duda, "Chaperone-protein interactions that mediate assembly of the bacteriophage lambda tail to the correct length," *J. Mol. Biol.*, vol. 426, no. 5, pp. 1004-1018, March 2014.

[28] D. Schwarzer et al., "Proteolytic Release of the Intramolecular Chaperone Domain Confers Processivity to Endosialidase F," *J. Biol. Chem.*, vol. 284, no. 14, pp. 9465-9474, April 2009.

[29] D. Schwarzer et al., "A Multivalent Adsorption Apparatus Explains the Broad Host Range of Phage phi92: a Comprehensive Genomic and Structural Analysis," *J. Virol.*, vol. 86, no. 19, pp. 10384-10398, October 2012.

[30] "Characterization of a Vil-like phage specific to *Escherichia coli* O157:H7.—PubMed-NCBI." [Online]. Available: https://www.ncbi.nlm.nih.gov/pubmed/21899740. [Accessed: 10 Dec. 2018].

[31] C. Chen, P. Bales, J. Greenfield, R. D. Heselpoth, D. C. Nelson, and O. Herzberg, "Crystal structure of ORF210 from *E. coli* O157:H1 phage CBA120 (TSP1), a putative tailspike protein," *PloS One*, vol. 9, no. 3, p. e93156, 2014.

[32] A. K. Golomidova et al., "Branched Lateral Tail Fiber Organization in T5-Like Bacteriophages DT57C and DT571/2 is Revealed by Genetic and Functional Analysis," *Viruses*, vol. 8, no. 1, January 2016.

| SEQUENCES | | | | |
|---|---|---|---|---|
| SEQ ID NO | Name | Protein (PRT) or DNA | Origin | Insertion site |
| 1 | lambda stf | PRT | lambda bacteriophage | |
| 2 | STF-25 | PRT | Artificial sequence | ADAKKS |
| 3 | STF25-AP1 | PRT | Artificial sequence | |
| 4 | STF-27 | PRT | Artificial sequence | ADAKKS |
| 5 | STF27-AP1 | PRT | Artificial sequence | |
| 6 | STF27-AP2 | PRT | Artificial sequence | |
| 7 | STF-28 | PRT | Artificial sequence | ADAKKS |
| 8 | STF28-AP1 | PRT | Artificial sequence | |
| 9 | STF-15 | PRT | Artificial sequence | SASAAA |
| 10 | STF15-AP1 | PRT | Artificial sequence | |
| 11 | STF15-AP2 | PRT | Artificial sequence | |
| 12 | STF-16 | PRT | Artificial sequence | SASAAA |
| 13 | STF16-AP1 | PRT | Artificial sequence | |
| 14 | STF16-AP2 | PRT | Artificial sequence | |
| 15 | STF-17 | PRT | Artificial sequence | SASAAA |
| 16 | STF17-AP1 | PRT | Artificial sequence | |
| 17 | STF-13 | PRT | Artificial sequence | SASAAA |
| 18 | STF13-AP1 | PRT | Artificial sequence | |
| 19 | STF13-AP2 | PRT | Artificial sequence | |
| 20 | STF-12 | PRT | Artificial sequence | SASAAA |
| 21 | STF12-AP1 | PRT | Artificial sequence | |
| 22 | STF12-AP2 | PRT | Artificial sequence | |
| 23 | STF-63 | PRT | Artificial sequence | SASAAA |
| 24 | STF-62 | PRT | Artificial sequence | SASAAA |
| 25 | STF-71 | PRT | Artificial sequence | SASAAA |
| 26 | STF71-AP1 | PRT | Artificial sequence | |
| 27 | STF-20 | PRT | Artificial sequence | MDETNR |
| 28 | STF20-AP1 | PRT | Artificial sequence | |
| 29 | STF-23 | PRT | Artificial sequence | MDETNR |
| 30 | STF23-AP1 | PRT | Artificial sequence | |
| 31 | STF-24 | PRT | Artificial sequence | MDETNR |
| 32 | STF24-AP1 | PRT | Artificial sequence | |
| 33 | O111-2.0 | PRT | Artificial sequence | MDETNR |
| 34 | O111 2.0-AP1 | PRT | Artificial sequence | |
| 35 | STF-74 | PRT | Artificial sequence | MDETNR |
| 36 | STF74-AP1 | PRT | Artificial sequence | |
| 37 | STF-86 | PRT | Artificial sequence | MDETNR |
| 38 | STF86-AP1 | PRT | Artificial sequence | |
| 39 | STF-84 | PRT | Artificial sequence | MDETNR |
| 40 | STF84-AP1 | PRT | Artificial sequence | |
| 41 | STF-93 | PRT | Artificial sequence | MDETNR |
| 42 | STF-95 | PRT | Artificial sequence | MDETNR |
| 43 | STF95-AP1 | PRT | Artificial sequence | |
| 44 | STF-132 | PRT | Artificial sequence | MDETNR |
| 45 | STF132-AP1 | PRT | Artificial sequence | |
| 46 | K1F | PRT | Artificial sequence | GAGENS |
| 47 | K5 | PRT | Artificial sequence | GAGENS |
| 48 | STF-37 | PRT | Artificial sequence | GAGENS |
| 49 | 1JL | PRT | Artificial sequence | GAGENS |
| 50 | STF-48 | PRT | Artificial sequence | GAGENS |
| 51 | STF-49 | PRT | Artificial sequence | GAGENS |
| 52 | STF-52 | PRT | Artificial sequence | GAGENS |
| 53 | 1AR | PRT | Artificial sequence | GAGENS |
| 54 | 1AR-AP1 | PRT | Artificial sequence | |
| 55 | 1AR-AP2 | PRT | Artificial sequence | |
| 56 | 13-13.0 | PRT | Artificial sequence | GAGENS |
| 57 | 13-13.0-AP1 | PRT | Artificial sequence | |
| 58 | 13-13.0-AP2 | PRT | Artificial sequence | |
| 59 | 13-14.3 | PRT | Artificial sequence | SAGDAS |
| 60 | 13-14.3-AP1 | PRT | Artificial sequence | |
| 61 | 13-14.3-AP2 | PRT | Artificial sequence | |
| 62 | STF-25 | DNA | Artificial sequence | |
| 63 | STF25-AP1 | DNA | Artificial sequence | |
| 64 | STF-27 | DNA | Artificial sequence | |
| 65 | STF27-AP1 | DNA | Artificial sequence | |
| 66 | STF27-AP2 | DNA | Artificial sequence | |
| 67 | STF-28 | DNA | Artificial sequence | |
| 68 | STF28-AP1 | DNA | Artificial sequence | |
| 69 | STF-15 | DNA | Artificial sequence | |
| 70 | STF15-AP1 | DNA | Artificial sequence | |
| 71 | STF15-AP2 | DNA | Artificial sequence | |
| 72 | STF-16 | DNA | Artificial sequence | |
| 73 | STF16-AP1 | DNA | Artificial sequence | |
| 74 | STF16-AP2 | DNA | Artificial sequence | |
| 75 | STF-17 | DNA | Artificial sequence | |
| 76 | STF17-AP1 | DNA | Artificial sequence | |

-continued

| SEQ ID NO | Name | Protein (PRT) or DNA | Origin | Insertion site |
|---|---|---|---|---|
| 77 | STF-13 | DNA | Artificial sequence | |
| 78 | STF13-AP1 | DNA | Artificial sequence | |
| 79 | STF13-AP2 | DNA | Artificial sequence | |
| 80 | STF-12 | DNA | Artificial sequence | |
| 81 | STF12-AP1 | DNA | Artificial sequence | |
| 82 | STF12-AP2 | DNA | Artificial sequence | |
| 83 | STF-63 | DNA | Artificial sequence | |
| 84 | STF-62 | DNA | Artificial sequence | |
| 85 | STF-71 | DNA | Artificial sequence | |
| 86 | STF71-AP1 | DNA | Artificial sequence | |
| 87 | STF-20 | DNA | Artificial sequence | |
| 88 | STF20-AP1 | DNA | Artificial sequence | |
| 89 | STF-23 | DNA | Artificial sequence | |
| 90 | STF23-AP1 | DNA | Artificial sequence | |
| 91 | STF-24 | DNA | Artificial sequence | |
| 92 | STF24-AP1 | DNA | Artificial sequence | |
| 93 | O111-2.0 | DNA | Artificial sequence | |
| 94 | O111 2.0-AP1 | DNA | Artificial sequence | |
| 95 | STF-74 | DNA | Artificial sequence | |
| 96 | STF74-AP1 | DNA | Artificial sequence | |
| 97 | STF-86 | DNA | Artificial sequence | |
| 98 | STF86-AP1 | DNA | Artificial sequence | |
| 99 | STF-84 | DNA | Artificial sequence | |
| 100 | STF84-AP1 | DNA | Artificial sequence | |
| 101 | STF-93 | DNA | Artificial sequence | |
| 102 | STF-95 | DNA | Artificial sequence | |
| 103 | STF95-AP1 | DNA | Artificial sequence | |
| 104 | STF-132 | DNA | Artificial sequence | |
| 105 | STF132-AP1 | DNA | Artificial sequence | |
| 106 | K1F | DNA | Artificial sequence | |
| 107 | K5 | DNA | Artificial sequence | |
| 108 | STF-37 | DNA | Artificial sequence | |
| 109 | 1JL | DNA | Artificial sequence | |
| 110 | STF-48 | DNA | Artificial sequence | |
| 111 | STF-49 | DNA | Artificial sequence | |
| 112 | STF-52 | DNA | Artificial sequence | |
| 113 | 1AR | DNA | Artificial sequence | |
| 114 | 1AR-AP1 | DNA | Artificial sequence | |
| 115 | 1AR-AP2 | DNA | Artificial sequence | |
| 116 | 13-13.0 | DNA | Artificial sequence | |
| 117 | 13-13.0-AP1 | DNA | Artificial sequence | |
| 118 | 13-13.0-AP2 | DNA | Artificial sequence | |
| 119 | 13-14.3 | DNA | Artificial sequence | |
| 120 | 13-14.3-AP1 | DNA | Artificial sequence | |
| 121 | K1F | PRT | K1F phage | |
| 122 | 13-14.3-AP2 | DNA | Artificial sequence | |
| 123 | lambda stf | PRT | lambda phage | |
| 124 | WW11 stf1 | PRT | WW11 phage | |
| 125 | WW11 stf2 | PRT | WW11 phage | |
| 126 | K1F | PRT | K1F phage | |
| 127 | TSP4 Branched | PRT | CBA120 phage | |
| 128 | TSP3 Branched | PRT | CBA120 phage | |
| 129 | TSP2 Branched | PRT | CBA120 phage | |
| 130 | TSP1 Branched | PRT | CBA120 phage | |
| 131 | ID4 Branched | PRT | CBA120 phage | |
| 132 | ID3 Branched | PRT | CBA120 phage | |
| 133 | ID2 Branched | PRT | CBA120 phage | |
| 134 | ID1 branched | PRT | CBA120 phage | |
| 135 | WW13 | PRT | Artificial sequence | GNIIDL |
| 136 | PP-1 | PRT | Artificial sequence | IATRV |
| 137 | WW55 | PRT | Artificial sequence | TPGEL |
| 138 | WW34 | PRT | Artificial sequence | TPGEL |
| 139 | WW14 | PRT | Artificial sequence | NQIID |
| 140 | WW170 | PRT | Artificial sequence | GAIIN |
| 141 | WW202 | PRT | Artificial sequence | GQIVN |
| 142 | WW13 13.0 | PRT | Artificial sequence | IIQLED |
| 143 | WW13 10.0 | PRT | Artificial sequence | VDRAV |
| 144 | WW13-G8 | PRT | Artificial sequence | GNIIDL |
| 145 | WW13 gp38 | PRT | ww13 phage | |
| 146 | WW13 gp57A | PRT | ww13 phage | |
| 147 | PP-1 | PRT | Artificial sequence | IATRV |
| 148 | PP-1 gp38 | PRT | pp-1 phage | |
| 149 | PP-1 gp57A | PRT | pp-1 phage | |
| 150 | WW55 3.0 | PRT | Artificial sequence | TPGEL |

-continued

SEQUENCES

| SEQ ID NO | Name | Protein (PRT) or DNA | Origin | Insertion site |
|---|---|---|---|---|
| 151 | WW55-G8 | PRT | Artificial sequence | GAIIN |
| 152 | WW55 gp38 | PRT | ww55 phage | |
| 153 | WW55 gp57A | PRT | ww55 phage | |
| 154 | WW34 3.0 | PRT | Artificial sequence | TPGEL |
| 155 | WW34 gp38 | PRT | ww34 phage | |
| 156 | WW34 gp57A | PRT | ww34 phage | |
| 157 | WW14-G8 | PRT | Artificial sequence | NQIID |
| 158 | WW14 gp38 | PRT | ww14 phage | |
| 159 | WW14 gp57A | PRT | ww14 phage | |
| 160 | WW170-G8 | PRT | Artificial sequence | GAIIN |
| 161 | WW170 gp38 | PRT | ww170 phage | |
| 162 | WW170 gp57A | PRT | ww170 phage | |
| 163 | WW202-G8 | PRT | Artificial sequence | GQIVN |
| 164 | WW202 gp38 | PRT | ww202 phage | |
| 165 | WW202 gp57A | PRT | ww202 phage | |
| 166 | WW13 13.0 | DNA | Artificial sequence | |
| 167 | WW13 10.0 | DNA | Artificial sequence | |
| 168 | WW13-G8 | DNA | Artificial sequence | |
| 169 | WW13 GP38 | DNA | ww13 phage | |
| 170 | WW13 GP57A | DNA | ww13 phage | |
| 171 | PP-1 | DNA | Artificial sequence | |
| 172 | PP-1 GP38 | DNA | pp-1 phage | |
| 173 | PP-1 GP57A | DNA | pp-1 phage | |
| 174 | WW55 3.0 | DNA | Artificial sequence | |
| 175 | WW55-G8 | DNA | Artificial sequence | |
| 176 | WW55 GP38 | DNA | ww55 phage | |
| 177 | WW55 GP57A | DNA | ww55 phage | |
| 178 | WW34 3.0 | DNA | Artificial sequence | |
| 179 | WW34 GP38 | DNA | ww34 phage | |
| 180 | WW34 GP57A | DNA | ww34 phage | |
| 181 | WW14-G8 | DNA | Artificial sequence | |
| 182 | WW14 GP38 | DNA | ww14 phage | |
| 183 | WW14 GP57A | DNA | ww14 phage | |
| 184 | WW170-G8 | DNA | Artificial sequence | |
| 185 | WW170 GP38 | DNA | ww170 phage | |
| 186 | WW170 GP57A | DNA | ww170 phage | |
| 187 | WW202-G8 | DNA | Artificial sequence | |
| 188 | WW202 GP38 | DNA | ww202 phage | |
| 189 | WW202 GP57A | DNA | ww202 phage | |
| 190 | insertion sequence | PRT | Artificial sequence | |
| 191 | insertion sequence | PRT | Artificial sequence | |
| 192 | insertion sequence | PRT | Artificial sequence | |
| 193 | insertion sequence | PRT | Artificial sequence | |
| 194 | insertion sequence | PRT | Artificial sequence | |
| 195 | insertion sequence | PRT | Artificial sequence | |
| 196 | insertion sequence | PRT | Artificial sequence | |
| 197 | insertion sequence | PRT | Artificial sequence | |
| 198 | insertion sequence | PRT | Artificial sequence | |
| 199 | insertion sequence | PRT | Artificial sequence | |
| 200 | insertion sequence | PRT | Artificial sequence | |
| 201 | insertion sequence | PRT | Artificial sequence | |
| 202 | insertion sequence | PRT | Artificial sequence | |
| 203 | insertion sequence | PRT | Artificial sequence | |
| 204 | AG22 | PRT | AG22 phage | |
| 205 | SIEA11 | PRT | SIEA11 phage | |
| 206 | WW13 | DNA | WW13 phage | |
| 207 | PP-1 | DNA | PP-1 phage | |
| 208 | WW55 | DNA | WW55 phage | |
| 209 | WW34 | DNA | WW34 phage | |
| 210 | WW14 | DNA | WW14 phage | |
| 211 | WW170 | DNA | WW170 phage | |
| 212 | WW202 | DNA | WW202 phage | |
| 213 | AG22 | DNA | AG22 phage | |
| 214 | SIEA11 | DNA | SIEA11 phage | |
| 215 | O111 | PRT | Artificial sequence | |
| 216 | SIED6 | PRT | Artificial sequence | |
| 217 | SIED6 AP1 | PRT | Artificial sequence | |
| 218 | SIED6 AP2 | PRT | Artificial sequence | |
| 219 | SIEA11 | PRT | Artificial sequence | |
| 220 | SIEA11 AP1 | PRT | Artificial sequence | |
| 221 | DC1 | PRT | Artificial sequence | |
| 222 | DC1 AP1 | PRT | Artificial sequence | |
| 223 | EB6 | PRT | Artificial sequence | |
| 224 | EB6 AP1 | PRT | Artificial sequence | |

-continued

SEQUENCES

| SEQ ID NO | Name | Protein (PRT) or DNA | Origin | Insertion site |
|---|---|---|---|---|
| 225 | AH11L | PRT | Artificial sequence | |
| 226 | AH11L AP1 | PRT | Artificial sequence | |
| 227 | STF-94A | PRT | Artificial sequence | |
| 228 | STF-94A AP1 | PRT | Artificial sequence | |
| 229 | STF-69A | PRT | Artificial sequence | |
| 230 | STF-69A AP1 | PRT | Artificial sequence | |
| 231 | STF-69A AP2 | PRT | Artificial sequence | |
| 232 | STF-68B | PRT | Artificial sequence | |
| 233 | STF-68B AP1 | PRT | Artificial sequence | |
| 234 | STF-68B AP2 | PRT | Artificial sequence | |
| 235 | STF-118 | PRT | Artificial sequence | |
| 236 | STF-118 AP1 | PRT | Artificial sequence | |
| 237 | STF-90B | PRT | Artificial sequence | |
| 238 | STF-90B AP1 | PRT | Artificial sequence | |
| 239 | STF-117 | PRT | Artificial sequence | |
| 240 | STF-117 AP1 | PRT | Artificial sequence | |
| 241 | STF-66D | PRT | Artificial sequence | |
| 242 | STF-66D AP1 | PRT | Artificial sequence | |
| 243 | O111 | DNA | Artificial sequence | |
| 244 | SIED6 | DNA | Artificial sequence | |
| 245 | SIED6 AP1 | DNA | Artificial sequence | |
| 246 | SIED6 AP2 | DNA | Artificial sequence | |
| 247 | SIEA11 | DNA | Artificial sequence | |
| 248 | SIEA11 AP1 | DNA | Artificial sequence | |
| 249 | DC1 | DNA | Artificial sequence | |
| 250 | DC1 AP1 | DNA | Artificial sequence | |
| 251 | EB6 | DNA | Artificial sequence | |
| 252 | EB6 AP1 | DNA | Artificial sequence | |
| 253 | AH11L | DNA | Artificial sequence | |
| 254 | AH11L AP1 | DNA | Artificial sequence | |
| 255 | STF-94A | DNA | Artificial sequence | |
| 256 | STF-94A AP1 | DNA | Artificial sequence | |
| 257 | STF-69A | DNA | Artificial sequence | |
| 258 | STF-69A AP1 | DNA | Artificial sequence | |
| 259 | STF-69A AP2 | DNA | Artificial sequence | |
| 260 | STF-68B | DNA | Artificial sequence | |
| 261 | STF-68B AP1 | DNA | Artificial sequence | |
| 262 | STF-68B AP2 | DNA | Artificial sequence | |
| 263 | STF-118 | DNA | Artificial sequence | |
| 264 | STF-118 AP1 | DNA | Artificial sequence | |
| 265 | STF-90B | DNA | Artificial sequence | |
| 266 | STF-90B AP1 | DNA | Artificial sequence | |
| 267 | STF-117 | DNA | Artificial sequence | |
| 268 | STF-117 AP1 | DNA | Artificial sequence | |
| 269 | STF-66D | DNA | Artificial sequence | |
| 270 | STF-66D AP1 | DNA | Artificial sequence | |
| 271 | WW55 3.0 AP1 | PRT | Artificial sequence | |
| 272 | WW55 3.0 AP1 | DNA | Artificial sequence | |
| 273 | WW55 3.0 AP2 | PRT | Artificial sequence | |
| 274 | WW55 3.0 AP2 | DNA | Artificial sequence | |
| 275 | lambda stf AP1 | PRT | Artificial sequence | |
| 276 | lambda stf AP1 | DNA | Artificial sequence | |
| 277 | payload p7.3 | DNA | Artificial sequence | |
| 278 | 1A2 gpJ variant | PRT | Artificial sequence | |
| 279 | 1A2 gpJ variant | DNA | Artificial sequence | |
| 280 | WW11 ID1 | DNA | Artificial sequence | |
| 281 | WW11 ID2 | DNA | Artificial sequence | |
| 282 | WW11 K1F chimeric stfa | PRT | Artificial sequence | |
| 283 | WW11 K1F chimeric stfb | PRT | Artificial sequence | |
| 284 | WW11 K1F chimeric stf | DNA | Artificial sequence | |

SEQUENCE LISTING (284 sequences)

SEQ ID NO: 1 - protein, 774 aa, Escherichia virus Lambda
  misc_feature: lambda bacteriophage
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSAFPAGAPIPWPSDIVPSGYVLMQGQAFDKSAYPKLAVAYPSGVLPDMRGWTIKGKPASGRAVLSQEQDGIKSHTHSASASGTDLGTKTTSSFDYGTKTTGSFDYGTKSTNNTGAHAHSLSGSTGAAGAHAHTSGLRMNSSGWSQYGTATITGSLSTVKGTSTQGIAYLSKTDSQGSHSHSLSGTAVSAGAHAHTVGIGAHQHPVVIGAHAHSFSIGSHGHTITVNAAGNAENTVKNIAFNYIVRLA

SEQ ID NO: 2 - protein, 686 aa, Artificial sequence
  Synthetic: STF-25
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSRNAAKTSETNAGNSAKAAASSKTAAQNAATAAERSETNARASEEASADSEEASRRNAESAAENAGVATTKAREAAADATKAGQKKDEALSAATRAEKAADRAEAAAEVTAEPCANIVPPLPDVWIPFNDSLDMIAGFSPGYKKIAIGDDVVQVASDKQVNFSRASTATYINKSGELKTAEINEPRFECDGLLIEGQRTNYMLNSESPASWGKSSNMDVPETGTDSFGFTYGKFVCNDSLVGQTSAINMASIAATKSVDVSGDNKYVTTSCRFKTERQVRLRIRFDKYDGSATTFLGDAYIDTQTLEISMTGGAAGRITARVRKDKTTGWIFAEATIQAIDGELKIGSQIQYSPGQGGATVSGDYIYLATPQVENGPCVSSFIISGGSATTRASDLVSIPTRNNLYKLPFTFLLEIHKNWDIAPNAAPRVWDIAAANTGQSAIAAINRGSGKLYMSLSNPSGSYVNSAATDVFAEKTTFGCIAKADGHFHVVTNGKAVNEVYCEYNGVTADKNIRFGGQTNTGERHLFGHIRNFRIWHKELNDRQLKEVV

SEQ ID NO: 3 - protein, 92 aa, Artificial sequence
  Synthetic: STF25-AP1
MKDLTLKFHDKLQFKAFLSSLGWAEDEDLQNKLLVDEIGFTYTETGVTEEGEPVCIRNDGYFVNIRILDDLFDVSVFSDYVVELETPLREWS

SEQ ID NO: 4 - protein, 687 aa, Artificial sequence
  Synthetic: STF-27
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSKNAAKTSETNAANSAQAAAASQTASANSATAAKKSETSAKNSETATKASEKNAKSSQTAAKTSETNAKDSEANAKVSETAAANSAKASAASQTAAKASEDAAREYANQTAEPYRYVLQPLPDVWIPFNDSLDMITGYSPGYKKVKIGDNVVQVASDKQVNFSRASTATYINKSGELKTAEINEPRFECDGLLIEGQRTNFFQNSTDPSKWNKSTSLDVTETGTDSFGFNYGRFVVQDSIVGTSKAHTIIGLYSSTGGVDTSGDEKHVTISCRVKSEVDNIAVRILFEHYDGEVRTSIGAANLNLTTRIISKTGQTSRVTARSVKDDATGWIFFEATLKADTTENTVGGFVQYSPDTGQMVTSGDYLDVTTPQIEAGTGASSFIVTGTAPATRASDMVTVPIKNNLYNLPFTVLCEVHKNWYKTPNVAPRVFDTGGHQTGAGIVMGFGSSGGYDGFPYCDIGGSDRRINENAGLEKMLIGMRVKSERSTCVVSNGKLSSETKTKWEYIRSTATIRIGGQTTAGLRHLFGHVRNFRLWHKELTDAQLGEVVE

SEQ ID NO: 5 - protein, 92 aa, Artificial sequence
  Synthetic: STF27-AP1
VRDFTLRFSDKADFRAFLRKLNWEEDEELQNAVLVDEIGFTFRETDVSDDGEPEYTRNEGYFVNIRLLDDGFEDSVFREWVVTPERPLREWF

SEQ ID NO: 6 - protein, 88 aa, Artificial sequence
  Synthetic: STF27-AP2
MLPQHSDIEIAWYASIQQEPNGWKTVTTQFYIQEFSEYIAPLQDAVDLEIATEEERSLLEAWNKYRVLLNRVDTSTAPDIEWPTSPAE

SEQ ID NO: 7 - protein, 673 aa, Artificial sequence
  Synthetic: STF-28
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSRNAAKTSETNAGNSAKAAASSKTAAQNAATAAERSETNARASEEASADSEEASRRNAESAAENAGVATTKAREAAADATKAGQKKDEALSAATRAEKAADRAESAAEVTAEPCANIVPPLPDVWIPFNDSLDMITGFSPSYKKIVIGDDEITMPGDKIVKFKRASTATYINKSGQLKLAEVDEPRFERDGLLIEGQRTNYLRNSNKPDSWTVHSALNKTFGTDKQGFNYATVTPTESIVGTTGGYTVHGVVAADRFPLASGECFTFSCRVKGAKARCRLRVSVIIGGTDTFSADSYLDLDTRIATVSGNTSLITAKAEQQGEWTYYEATYTANTDIDTVNCAFYMTNKISNEPFYDDSTLTMTTPQIELGNTASSFIVTTMPTTRASDVVTIPSANNLSTRPFTVLCEVRRNWSTPPNVAPRIFDVGGHSIDDNYLSLGFVSTGKISANVGMVQPQISSDGERFIVGVRAKSDLSVNAICNGNYTTNLNGKIFGVTATSYRFGGQTAAGTRHLFGHIRNFRVWFKELNDRQIKEAV

SEQ ID NO: 8 - protein, 92 aa, Artificial sequence
  Synthetic: STF28-AP1
MKDLTLKFPGNREFKSFLSSLDWEEDEDLQNKLLVDEIGFTYTETGVTEEGEPVCIRNNGYFVNIRILDDLFDVSVFSDYVVELETPLREWS

SEQ ID NO: 9 - protein, 798 aa, Artificial sequence
  Synthetic: STF-15
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKVSETAAANSAKASAASQTAAKASEDAAREYASQAAEPYKYVLQPLPDVWIPFNDSLDMITGFSPSYKKIVIGDDEITMPGDKVVKFKRASTATYINKSGVFSVAKIDEPRFEKEGLLIEGQRTNYFVKSNTPAEWTSTSNIDKTNNGVDEFGFSYAKMRTKDNMTGQSSALSLHRCSASRGIDVSGDNKYCTVSCRVKAPDGLRCRLRFEKYDGSVYTFLGDAYLTFGTLIIEKTGGAANRIAATATKDPVTGWIFYEATIEAVEGETLIGAMIQYAPKKGGITEAGDYIYLATPQFENGGCASSFVITTTAPATRSSDMVTIPTKNNIYNRPLTCLVEVNRIWGDIPPNVAPRIFDFSGVPPIESITYAFNTTEKYYGQLYMQTYKASTSTYVSSVFAGRADVRKFIGGFNIYSDGTKRVVSNGEATKTMKTEWTGVKTRTFIRIGGQATSGTRHLFGHLRNLRLWHKELTDAQMGESIK

SEQ ID NO: 10 - protein, 93 aa, Artificial sequence
  Synthetic: STF15-AP1
MKDLTLKFADRADFSAFMESIGYYDDESMQDDILIDVIGNVYKETGELTEDGEPACVKEDGYFVNVRIINDSQISSLFDEHAVAVEHQLRSWM

SEQ ID NO: 11 - protein, 234 aa, Artificial sequence
  Synthetic: STF15-AP2
MATSTVIPDDIKTLKGDVSKAKEDISSINVKVSTLQTDMDSAKQDISTRYTKTEVDNKLKNKVEVNDLESGRYGGDFYPLTGREAFYLWGLGTTTAAANLYLNPDPAISSVLRSTSSIRYKHSVETIDSEHADLIFRMRPVWYRSQCENDRRDWGFYGLIAEEVGEIAPQFVHWRPANEDDAPETISSNGLVAEGVMYERLVVPLIHHIQKLTERVDELESELKLLSTSQSDIG

SEQ ID NO: 12 - protein, 791 aa, Artificial sequence
  Synthetic: STF-16
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAKASAASQTAAKASEDAAREYASQAADPYKYVLQPLPDVWIPFNDSLDMITGFSPSYKKIVIGDDEITMPGDKIVKFKRASKATYINKSGVLTEAAIDEPRFERDGLLIEGQRTNLLLNSTNPSKWNKSGNLELTEISTDSFNFTYGRFTVKDTLIGQTSAINIVTISGSKGFDVTGDEKYVTISCRVRSDVENIRCRLRFEHHDGYTYTFLGDAYLNLSTLVIDKTGTAADRIIAKAVKDEVTGWIFYQATINALDTESMIGAMVQYAPVKGSGTASGDYLDIATPQVEGGSSASSFIVTDITASTRASDMVTVPIKNNLYNLPFTVLCEVHKNWYKTPNAAPRVFDTGGHQTGAAIILGFGRSTDYDGFPYCDIGLANRRVNENASLEKMVMGMRVKSDQSTCSVSNGRISSEKKATWSYIQNSAIIRIGGQTTAGLRHLFGHVRNFRIWHKALTDAQMGESI

SEQ ID NO: 13 - protein, 93 aa, Artificial sequence
  Synthetic: STF16-AP1
MKDLTLKFADRADFSAFMDSIGYYDDESMQDDILIDVIGNVYKETGELTEDGEPVCVKEDGYYVNVRIINDAKKSSIFDEYAVVVEHQLRGWM

SEQ ID NO: 14 - protein, 234 aa, Artificial sequence
  Synthetic: STF16-AP2
MATSTVIPGDITTLKGDVSKAKEDISSINGKVSTLQADMTSAKQDISTRYTKTEVDNKLKNKLEVNALESGRYGGDFYPLTGREAFYLWGLGTTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLSVSRSDIG

SEQ ID NO: 15 - protein, 941 aa, Artificial sequence
  Synthetic: STF-17
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAGSKTAAALSASAASTSAGQASASATAAGKSAESAASSASTATTKAGKATEQATAAARSASAAKTSETNAKTSADNAASSKAAAASSASSAASSASSASASKDEATRQASAAKGSATTASTKATEAAGSATAAAQSKSTAESAATRAETAAKRAEDIASAVALEDASTTKKGIVQLSSATNSTSESLAATPKAVKAVMGETNKKAPLNSPALTGTPTTPTARQGTNNTQIASTAYVMAAIAALVDSSPDALNTLNELAAALGNDPNFATTMTSALAGKQPKDATLTALAGLATAADRFPYFTGNDVASLATLTKVGRDILAKSTVAAVIEYLGLRELGTSGEKIPLLSTANTWTNRQTFSGGLSGELSGNASTAAKLKTARKISNVAFDGSSDITLKASHVGAFALGKTGSTVANDKAVGWNWSSGAYNATISGASTLIIHFYMGEGSCPAAQFRINYKNGGIFYRSARDGYGFEADWSEFYTTTRKPSAGDVGALPLSGGQLNGALGIGTSSALGGNSIVLGDNDTGFKQNGDGNLDVYANNVHVMRFVSGSIQSNKTINITGRVNPSDYGNFDSRYVKDVRLGSQQYYGVNNWQTWNFQCPSGHVLSGINVQDTGSNSADNIAGVYYRPVQKYINGTWYNVASV

SEQ ID NO: 16 - protein, 177 aa, Artificial sequence
  Synthetic: STF17-AP1
MMHLKNIKAGNAKTLEQYELTKKHGVIWLYSEDGKNWYEEVKNFQPDTIKIVYDENNIIVAITKDASTLNPEGYSVVEIPDITANRRADDSGKWMFKDGAVIKRVYTEEELRLQTENQKKILLQQAREKTQFWQTQLTLGIITDSDRQQLMNWMRYVQQVETTDTSVLPVTFPEPPE

SEQ ID NO: 17 - protein, 791 aa, Artificial sequence
  Synthetic: STF-13
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAASSATASANSQKAAKTSETNAKASETAAANSAKASAASQTAAKASEDAAREYASQAAEPYKQVLQPLPDVWIPFNDSLDMLAGFSPGYKQITVGDDVIKMPSDKVVSFKRASGATYINKSGVLTVAEVDEPRFEREGLLIEGQRTNYHLNSLTPSKWGATTSVTITESGVDEFGFTYGRFQIKDEKIGTNTTMNIAAVSGGRGVDVTGTEKYVTTSCRVKSDSANIQCRIRFERYDGSAYFYLADAYLNITDMSIRKTGGGAARITARAEKESNGWIYFEVTYQSEAIDNMVGSQIQIAPPVSPGTYLGGEYLDVTTPQFEGGSCASSFIISDTVASTRASDIVTLPCKNNMASKPLTCMVEVNKNWSIAPNSAPRIYDITGFKTKDDAFVFAFRNTAGSVGTPYVQFGNPISFPPGNYPRKIIAVYRIKSDGKFQAGCNGVLSTPASTTWKSVSGATGIRIGGQTTAGLRHLFGYIRNFRIWHKELTDAQMGEII

SEQ ID NO: 18 - protein, 93 aa, Artificial sequence
  Synthetic: STF13-AP1
MRDLIIKFTDKADFSAFMKSAGYYDDESMQDDILIDVIGNVYKETGELTEDGEPVCVKEDGYFVNVRIINDAKKSSIFDKYAVVVEHQLRGWM

SEQ ID NO: 19 - protein, 234 aa, Artificial sequence
  Synthetic: STF13-AP2
MATSTVIPGDITKLKGDVSKAKEDISSISRKVSTLQTEMTSAKQDISSRYTKTEVDNKLKNKVEVNDLESGRYGGDFYPLTGREAFYLWNLATTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLLTSRSDIR

SEQ ID NO: 20 - protein, 781 aa, Artificial sequence
  Synthetic: STF-12
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAQASAASQTAAKASEDAAREYASQAAEPYKYVLQPLPDVWIPFNDSLDMLAGFSPGYKQITVGDDVIKMPSDKVVSFKRASGATYINKSGVLTVAEVDEPRFEREGLLIEGQRTNYFRNSNTPEAWNNTGSVSVESFDSDKGFNYGRITVINENPTAQGYQAIAVNTNDAYTCPAGSYTTISCLTKSDNSRCRARFGKMSDNGAFVFHSDAVLDPVTGNVVHGNNVTVTAERVGEWWLFTATLFADAEMIISSRFEILAMPGISIIPNGSTLDIAMPQAEIGSYRTSFIITEGAPGTRSSDMVTIPVRNNIHRLPFSALVEVNKNWDIPPSKSPLIFNVKDYQENGLFTHGFRGNNFSDAGSPFISMGGCNKYVATTQRKIISGFRCGADGDVQAVCNGELSVAAKTTWTSIVPRAVLRIGGQGTNGEYHLFGHIRNLRIWHKELTDAQMGESIK

SEQ ID NO: 21 - protein, 93 aa, Artificial sequence
  Synthetic: STF12-AP1
MKDLTLKFADRADFSAFMESIGYYDDESMQDDILIDVIGNVYKETGELTEDGEPVCVKEDGYFVNVRIINDVKKSSIFDKYAVVVEHQLRGWM

SEQ ID NO: 22 - protein, 234 aa, Artificial sequence
  Synthetic: STF12-AP2
MATSTVIPGDITTLKGDVSKTKEDISSINGKVSTLQTDMTSAKQDISTRYTKTEVDNKLKNKLEVNDLESGRYGGDFYPLTGREAFYMWGLGTTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLSVSRSDIG

SEQ ID NO: 23 - protein, 702 aa, Artificial sequence
  Synthetic: STF-63
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAANSATAAKKSETNAKNSESAAKVSETNAKASENKAKEYLDKVGGLVSPMTQYDWPVVTGNESFYIKIAKLSDPGSNNCHVTLMVTNGGDYGSPYGNIDFIEISARGLPSSLTADNVSRYLSIRRLGPTGLINSMQMRYGLVKDDGFIEVWAFQRAFINGAKVAVLAQTARTELYIPDGFVKQTAAPSGYVESPVVRIYDQLNKPTKADLGLSNAMLTGAFGLGGSGISTNGKMSDVEILKALRDKGGHFWRGDKPTGSTATIYSHGSGIFSRCGDTWSAINIDYSTAKIKIYAGNDARLNNGTFSINELYGSANKPSKSDVGLGNVTNDAQVKKTGDTMTGDLTIKKGTPSVFLRADSGVTALRFYTGDNTERGIIYAGPNTDSLGEVRIRAKTAGGTSGGDLVVRH

SEQ ID NO: 24 - protein, 1253 aa, Artificial sequence
  Synthetic: STF-62
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAANSATAAKKSETNAKNSEAAAKVSETNAKASENKAKEYLDKVGGLVSPMTQYDWPVVTASESLYIKIAKLSDPGTSRSHVTLMVTNAGNYGSPYGNIDFIEISARGLPSLLSADNVSRHLSIRRLGSTGLTDNNQMRYGLVKGDGFIEVWAFQGAFINDAKVAVLAQTTLNTELYIPDGFVKQTAAPSGYIEGNVVRIYDQVNKPTKADLGLSNAMLTGAFGLGGSGISTNGKMSDVEILKALRDKGGHFWRGDKPTGSTATIYSHGSGIFSRCGDTWSAINIDYSTAKIKIYAGNDARLNNGTFSVNELYGSANKPSKSDVGLGNVTNDAQVKKSGDVMSGDLDILKETPSIRLKSAKGTAHLWFMNNDGSERGVVWSPENNESLGEIHIRAKNTKGESSGDFIVRHDGRVEARNLKITYKISAATAEFANTSTSSDNTTVSIKGSQHTPLVLTSNNTIKNLSIGFKVDDVDQKYLGIAGDGDLYFGSYSDHTKNSKVITQAKLDSGVTVGGKTTFSDLATFNAGMAGSIEPETIDNKTIDLNDLIIANTVAGSVKYYQCKTVAGGAYITNKPDGVSGNFLLRVESTRKTTGSDYAIMQTLIGSDTKRIYVRFVVNGSWTEWSQVVVSGWNQDVTVRSLTSTTPSKLGGGRVDVLGSTSDYSSMNCAVRGVDSTGTNSAWSVGTSKNTGKMLCLKNHRSSAQVLLNGDDGAVQLLSGTVNGATAQALTINKDEVNSTADLVIRKQTGTGNRFALLNSGNSELPVGIRVWGSSTRQNVFEVGTSTAYLFYAQKTSAGQLFDVNGAINCTTLNQSSDRDLKDDILVISDATKAIRKMNGYTYTLRENGMPYAGVIAQEVMEAIPEAVGSFTHYGEELQGPTVDGNELREETRYLNVDYAAVTGLLVQFARETDDRVTALEEENTTLRQNLATADTRISTLENQVSELVALVRQLTGSEH

SEQ ID NO: 25 - protein, 790 aa, Artificial sequence
  Synthetic: STF-71
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAASSATASANSQKAAKTSETNAKASETAAANSAKASAASQTAAKASEDAAREYASQAAEPYKQVLQPLPDVWIPFNDSLDMITGFSPSYKKIVIGDDEITMSGDKVVKFKRASKATYINKSGVLTEAAIDEPRFERDGLLIEGQRTNYMLNSESPASWGRSSNMDVPETGTDNFGFTYGKFVCNDSLIGQTSAINMASIAATKSVDVSGDNKHVTTSCRFKTELQVRLRIRFDKYDGSATTFLGDAYIDTQTLEINMTGGAASRITARVRKDEATGWIFAEATIQAIDGELKIGSQIQYSPKQGGATVSGDYIYLATPQVENGPCVSSFIISGTTAATRASDIVTVPIKNNLYNLPFTVLCEVHKNWYKTPNAAPRVFDTGGHQTGAAIILGFGSSADYDGFPYCDIGGANRRVNENALLEKMVMGMRVKSDQSTCSVSNGRISSETKTTWSYIQNTAIIRIGGQTTAGLRHLFGHVRNFRIWHKALTDAQVGESI

SEQ ID NO: 26 - protein, 93 aa, Artificial sequence
  Synthetic: STF71-AP1
MKDLTLKLADRADFSAFMESTGYYDDESMQDDILIDVIGNVYKETGELNEDGEPVCVKEDGYFVNVRIINDVKTPSIFDEYVVAVEHQLRGWM

SEQ ID NO: 27 - protein, 1098 aa, Artificial sequence
  Synthetic: STF-20
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRLAKNQNGADIQDKSAFLDNIGVTSLTFMKNNGEMPVDADLNTFGPVKAYVGVWYKSTSSNATLEKNFPEDGAVGVLEVFNGGNFSGMQRYTTRTGNVYMRNLSGTWNGSDGPWIYWRQIQSATRPLSTTIDLNTLGGAEHLGLWRNSSGSIASFDRNYPEEGSYGQGFLEVLEGGGYSRTQRYTTRRGNVYVRCLSAIWNAQNPQWEPWSRVGHQSECRYYEGDLNDLTSPGIYSVTGKASNGPMQDTAGATLLGILEVIRRFDGVSVWQRYTTTGKSETTQGRTFERVYAGSKWTEWREVYNSFSLPLNLGIGGAVAKLSSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 28 - protein, 175 aa, Artificial sequence
  Synthetic: STF20-AP1
MQHLKNITAGNPKTVAQYQLTKNFDVIWLWSEEGKNWYEEVSNFQEDTIKIVYDENNIIVGITRDASTLNPEGFSVVEVPDITANRRADDSGKWMFKDGAVIKRIYTADEQLQLAELQKSALLSEAETIIQPLERSVRLNMATDDERSRLEAWERYSVLVSRVDPANPEWPEMPQ

SEQ ID NO: 29 - protein, 757 aa, Artificial sequence
  Synthetic: STF-23
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTARQGTNNTQIASTAFVMAAIAALVDSSPDALNTLNELAAALGNDPNFATTMTNALAGKQPKDATLTALAGLATAADRFPYFTGNDVASLATLTKVGRDILAKSTVAAVIEYLGLRELGTSGEKIPLLSTANTWTNRQTFSGGLSGGLSGNAATATKLKTARKIAGVGFDGSSDISISAKNVNAFALRQTGNTVNGDTSVGWNWDSGAYNALIGGASALILHFNINAGSCPAVQFRVNYKNGGISYRSARDGYGFELGWSDFYTTTRKPSAGDVGAYTRAECNSRFITGIRLGGLSSVQTWNGPGWSDRSGYVVTGSVNGNRDELIDTTQARPIQYCINGTWYNAGSI

SEQ ID NO: 30 - protein, 177 aa, Artificial sequence
  Synthetic: STF23-AP1
MMHLKNITAGNPKTKEQYQLTKQFNIKWLYSDDGKNWYEEQKNFQPDTLKMVYDHNGVIICIEKDVSAINPEGASVVELPDITANRRADISGKWLFKDGVVIKRTYTEEEQRQQAENEKQSLLQLVRDKTQLWDSQLRLGIISDENKQKLTEWMLYAQKVESTDTSSLPVTFPEQPE

SEQ ID NO: 31 - protein, 712 aa, Artificial sequence
  Synthetic: STF-24
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRLQKDQNGADIPDKRLFLRNIGATNSTTMSFSGGTGWFRLATVTMPQASSVVYISLIGGAGYNVNSPMQAGISELVLRAGNGNPKGLTGALWRRTSVGFTNFAWVNTSGDTYDVYVEIGNYATGVNIQWDYTSNASVTIHTSPTYTANKPTGLTDGTVYVIYSSYIKPTAADVGALSLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 32 - protein, 175 aa, Artificial sequence
  Synthetic: STF24-AP1
MQHLKNITAGNPKTVAQYQLTKNFDVIWLWSEEGKNWYEEVSNFQEDTIKIVYDENNIIVGITRDASTLNPEGFSVVEVPDITANRRADDSGKWMFKDGAVIKRIYTADEQLQLAELQKSALLSEAETIIQPLERSVRLNMATDEERSRLEAWERYSVLVSRVDPANPEWPEMPQ

SEQ ID NO: 33 - protein, 840 aa, Artificial sequence
  Synthetic: O111-2.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTAPQGTNSTQIASTAFVMAAIAALVDSSPDALNTLSELAAALGNDPNFATTMTNALAGKQPKDATLTALAGLVTAADRFPYFTGNDVASLATLTEVGRDILAKSTVAAVIEYLGLQETVNQASGALQKNQNGADIPGKDTFTKNIGACRAYSAWLNIGGDSQVWTTAQFISWLESQGAFNHPYWMCKGSWAYANNKVITDTGCGNICLAGAVVEVIGTRGAMTIRVTTPSTSSGGGITNAQFTYINHGDAYAPGWRRDYNTKNQQPAFALGQTGSRVANDKAVGWNWNSGVYNADISGASTLILHFNMNAGSCPAVQFRVNYRNGGIFYRSARDGYGFEANWSEFYTTTRKPSAGDVGAYTQAECNSRFITGIRLGGLSSVQTWNGPGWSDRSGYVVTGSVNGNRDELIDTTQARPIQYCINGTWYNAGSI

SEQ ID NO: 34 - protein, 177 aa, Artificial sequence
  Synthetic: O111 2.0-AP1
MMHLKNITAGNPKTKEQYQLTKQFNIKWLYSEDGKNWYEEQKNFQPDTLKMVYDHNGVIICIEKDVSAINPEGASVVELPDITANRRADISGKWMFKDGVVVKRTYTEEEQRQQAENEKQSLLQLVRDKTQLWDSQLRLGIISDENKQKLTEWMLFAQKVESTDTSSLPVTFPEQPE

SEQ ID NO: 35 - protein, 754 aa, Artificial sequence
  Synthetic: STF-74
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDASTAQKGLVKLSSATDSTSETLAATPKAVKAVNDNANGRVPSERKVNGHSLAGDISVTSQDIFDGQCVEIGPGQDLDNYQTPGLYFQPANANTSAALHYPENNAGSLMVLRSAGITQVYRVYSGSRSYLRSKYSTQPWTTWTPDDAFPVGAPIPWPSDIAPPAYALMQGQSFDKSAYPLLAVAYPSGVIPDMRGQTIKGKPDGRAVLSYEQDGIKSHAHTASISDTDLGTKYTNSFDYGSKPTTSFDYGNKSSTEGGWHVHNFRYCATSAYRDTPGSGLGMHSSNISWSAGDRIEGSGNHAHVTWIGPHDHWVGIGEHNHYVVMGYHGHTATVHATGNTENTVKNIAFNYIVRLA

SEQ ID NO: 36 - protein, 192 aa, Artificial sequence
  Synthetic: STF74-AP1
MAFEMTGENRTIILYNLRSDTNEFIGKSDGFIPANTGLPAYSTDIAPPKVTAGFVAVFDAQTNKWSRVEDYRGTTVYDISTGKPAVIEKLGALPDNVVSVAPDGEYVKWDGAKWIHDAEAEKTFRQGQAAQEKSNLLMIATSAIAPLQDAVDLDMATEDEATALNEWKKYRVMLNRVKPEDAPDITWPELPA

SEQ ID NO: 37 - protein, 710 aa, Artificial sequence
  Synthetic: STF-86
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPASRKVNGHALNGDINVTSRDIFDGQVIAIGANKNLDDYQVPGLYFQEANNNTSAAMNYPENSAGSLMVLRGAGVTQVYRVYNSSRSYSRSKYSTLAWTPWMPEDSYPVGAPIPWPSDVTPTGYALMQGQPFDKAVYPLLAIAYPAGIIPDMRGQTIKGKPNGRAVLSYEQDGVISHTHGASISDTDLGTKYTSSFDYGSKPTTSFDYGNKSSTEGGWHAHNFRYCATSAYRDTPGQGLGMHSSNVSWAAGDRIEGSGNHAHVTWIGPHDHWVGIGAHNHYVVMGYHGHTATVHAAGNAENTVKNIAFNYIVRLA

SEQ ID NO: 38 - protein, 195 aa, Artificial sequence
  Synthetic: STF86-AP1
MTFEMTGENRTITIYNLRADTNEFIGKSDGFIPANTGLPANSTNIAPPPMKAGFVAVFNSASEKWSLVEDHRGKIVYDILTGKSITIDELGQLPDDVVSVAPEGHFVKWNGKKWVHDADAEKTAQITQATQQKDSLLALAASKIAPLQDAVDLDIATEEETALLLAWKKYRVLINRIKPEDAPDIDWPEVPGDVA

SEQ ID NO: 39 - protein, 863 aa, Artificial sequence
  Synthetic: STF-84
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTAQKGIVQLSNATNSTSEMLAATPKSVKAAYDLANGKYTAQDATTAQKGIVQLSSATNSASETLAATPKAANDNANGRVPSARKVNGKALSADITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSGQFYPPGAPIPWPSDTVPSGYALMQGQTFDKSAYPKLAAAYPSGVIPDMRGWTIKGKPASGRAVLSQEQDGIKSHTHSASASSTDLGTKTTSSFDYGTKSTNNTGAHTHSVSGTAASAGNHTHSVTGASAVSQWSQNGSVHKVVSAASVNTSAAGAHTHSVSGTAASAGAHAHTVGIGAHTHSVAIGSHGHTITVNAAGNAENTVKNIAFNYIVRLA

SEQ ID NO: 40 - protein, 194 aa, Artificial sequence
  Synthetic: STF84-AP1
MAFRMSEQPRTIKIYNLLAGTNEFIGEGDAYIPPHTGLPANSTYIAPPDIPAGFVAVFNSDEGSWHLVEDHRGKTVYDVASGDALFISELGPLPENVTWLSPEGEFQKWNGTAWVKDAEAEKLFRIREAEETKNSLMQVASEHIAPLQDAVDLEIATEEETSLLEAWKKYRVLLNRVDTSTAPDIEWPTNPVRE

SEQ ID NO: 41 - protein, 1283 aa, Artificial sequence
  Synthetic: STF-93
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPSNRKVNGKALTADITLTPKDIGTLNSVTMSFSGGAGWFKLATVTMPQASSIVYIALIGGAGYNVGSPHQAGISELVLRAGNGNPKGITGALWKRTAVGLTNFAWINTSGDTYDIYVEIGNYATSVNIHWDCTANATVSIYTSPTYSASKPSSVTDGVVYTMYSTHQKPTPLDIGALPTTGGTVSGPLSVTGGITGTLNGNASTATKLQTARSIGGVGFDGSANINLPGVNTTGNQNTTGNAATATKLQTARTIGGVSFDGTANINLPGVNTTGNQNTTGNAATATKLQTARTINGVSFDGSANISLSPANIGCPASPTGWLTTGSNGGAITTAQLVTLLQNNGAFNTKSWIARCAWAYANSATIPNSETGCGVIPLAGAVIEVFNNGSSSNNYTIRITTATTTSVSGALTNAEFIYVFNGTDYSPGWRRVYNTKNKPTASDVGALPLTGGTLSGGLTSSGEIISKYANGFRIAYGSFGFFIRNDGSNTYFMLTASGDTLGSWNGLRPITINNTSGAVSIGNGLNVTGGVNGSLNGNASTATKLQTARNINGVKFDGSGDININTLVSRGRVTALSGSTQGTAGIQMYEAYNNSYPTTYGNVLHMKGASAAGEGELLIGWSGTSGAHAPVFIRSRRDTTDAAWSAWAQLYTAKDSIPGVNTTGNQNTTGNAATATKLQTARKIAGVAFDGSADITLTAANLNAYTKTEVTNLLSSYASRSSLTGYSGNLDIIAETLVVKSGGSGGFAIWDIGTTTSGANMYIDPNPGINTVWRSTSSRRYKKDIETLQDRYADELLSLRPVWYRSICRGDRKDWGYYGLIAEEVGEIAPQYVHWREPTNNDSPEDISSNGMVAEGVMYERLVVPLIHHIQQLTKRVEELETKLNSPKE

SEQ ID NO: 42 - protein, 798 aa, Artificial sequence
  Synthetic: STF-95
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPSARKVNGKALSADITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSEQFYPPGAPIPWPSDTVPSGYALMQGQTFDKSAYPKLAAAYPSGVIPDMRGWTIKGKPASGRAVLSQEQDGIKSHTHSASASSTDLGTKNTSSFDYGTKSTNNTGAHTHSLSGSTGSAGDHTHGNGIRWPGGGGSALAFYDGGGFTYVQDSQYQVSPGTSSRRSYYQRIQTQSAGAHTHSLSGTAASSGAHAHTVGIGAHTHSVAIGSHGHTITVNAAGNAENTVKNIAFNYIVRLA

SEQ ID NO: 43 - protein, 194 aa, Artificial sequence
  Synthetic: STF95-AP1
MAFRMSEQARTIKIYNLLAGTNEFIGEGDAYIPPHTGLPANSTDIAPPDIPAGFVAVFNSDEASWHLVEDHRGKTVYDVASGDELFISELGPLPENVTWLSPEGEFQKWNGTAWVKDTEAEKMFRIREAEETKNNLMQVASEHIAPLQDAADLEIATEEETSLLEAWKKYRVLLNRVDTSTAPDIEWPTNPVRE

SEQ ID NO: 44 - protein, 625 aa, Artificial sequence
  Synthetic: STF-132
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRAVQRDGDTMTGELKIRGVNALRIFNDAFGLIFRRSEECLHLIPTSEGQGENGDIGPLRPFTINLRTGEISMSHKVSVGGGSQVNGALGIGVQNALGGNSIAFGDNDTGIKQNGDGILDVYANGQHVFRFQNGALQSHRAVNVSGRVTPTDYGNFDERYQTKTGGVQNFQYTSEVFHKPAGNEVSWVFRAPSGCTLSGINVQETGSNSADNIGGVYYKQAQIYINGAWRSVSG

SEQ ID NO: 45 - protein, 188 aa, Artificial sequence
  Synthetic: STF132-AP1
MALSIRLIKAKIMELRNVTRYYPENMPYGEGVQYFRSEDGQDFYESLDKFAKKYKLCTHPETGVIYSMAEDVSRLYPAGFTIVEVDELPDGFCIEARWYYKDGEVLPVPVDYRLLAESERARLTAIAEREISDKKTDLLLGIINNGEKEMLKLWRMYIRNLKNIDFNHIHDKSSFDSIKWPCDPENSH

SEQ ID NO: 46 - protein, 1348 aa, Artificial sequence
  Synthetic: K1F
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGAKGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 47 - protein, 1154 aa, Artificial sequence
  Synthetic: K5
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSPKTEGILHKGQSLYEYLDARVLTSKPFGAAGDATTDDTEVIAASLNSQKAVTISDGVFSSSGINSNYCNLDGRGSGVLSHRSSTGNYLVFNNPRTGRLSNITVESNKATDTTQGQQVSLAGGSDVTVSDVNFSNVKGTGFSLIAYPNDAPPDGLMIKGIRGSYSGYATNKAAGCVLADSSVNSLIDNVIAKNYPQFGAVELKGTASYNIVSNVIGADCQHVTYNGTEGPIAPSNNLIKGVMANNPKYAAVVAGKGSTNLISDVLVDYSTSDARQAHGVTVEGSDNVINNVLMSGCDGTNSLGQRQTATIARFIGTANNNYASVFPSYSATGVITFESGSTRNFVEVKHPGRRNDLLSSASTIDGAATIDGTSNSNVVHAPALGQYIGSMSGRFEWRIKSMSLPSGVLTSADKYRMLGDGAVSLAVGGGTSSQVRLFTSDGTSRTVSLTNGNVRLSTSSTGYLQLGADAMTPDSTGTYALGSASRAWSGGFTQAAFTVTSDARCKTEPLTISDALLDAWSEVDFVQFQYLDRVEEKGADSARWHFGIIAQRAKEAFERHGIDAHRYGFLCFDSWDDVYEEDANGSRKLITPAGSRYGIRYEEVLILEAALMRRTIKRMQEALAALPK

SEQ ID NO: 48 - protein, 1075 aa, Artificial sequence
  Synthetic: STF-37
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSELSGEHGSFLIGGVIDCYSTVSDLISSSPSVGRVCRTIGYYSPGDGGGADYIISIGTPMQDFSDSGSIVIDECKFAKLIQQSQYDLKQFGVKPSDPSYAEKNDIFISQAITRSRVGRCKIIISDVIYHKKPLIFDYYNHMEGSCIGSDPEFTPRFIKIDNTTSGLPDMGYPGVADVVSYDVDAGIIIKRQNSGTSFARGFIIKGFLLQSEKKSAWAIYAPHMADFDIDIDSRGFNGGIRWFVNFLGRMAGRHIGLGANSSDPTLSIGAWCSKFSTIPDCGNSVVFRLSFNGFNRGMQMEYFGNGVLDRVTLENISKPTPTSPTTHGIYATDTWLTGQVSCESSSTCIIRAGNNANFDITLSAVFHVTQDDPSEGIVHVLNGGRLTLRSSTILADLADTKIINENGGYLDIAANTRTGNIVYSNSDNYRFKDRTIGFGQTAATTKTSFSSGEEITFSLLNGTPKANLSGGTIQFNSPCLIKITVQGRGITSGALTFGINGESSESVSQGQQVSMVVGVVSGDILNLKATSSLTLGSAGGVRVLLEPVN

SEQ ID NO: 49 - protein, 955 aa, Artificial sequence
  Synthetic: 1JL
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGYKVQSLAILSDTQAVHDATNTIKTQTDKIKADTQAIKTQTNQIKTETGVIRDKANTAKTDAQAASAAAQGFRDQAKEWAQSVNADNLLTKTGNLAGLTDKSAARSNLGLGSVATENTVPIKKGGTAATTVAAARSNLGLGSVATENTVPIEKGGTAATTAAKARSNLGLGSVATENTVPIEKGGTAATTAAKARSNFGLGDNNKVKLGTLRLNGGESLVFNDVERNGLIISNASFGIDSWVGQTMHKWYTDWTRAGLVRAGDAHLSDYRVHVWKDGFTEALFRFLPDGRLISGNSGNPSVNEFQKAPLSDRDLKKEIKYTDGEESYNRVRQWLPAMFKYKESDVQRYGLIAQDLARIDPEYVHLLPGYAIYEDVKGVDEEGNEVVVDRKEIGYTDDVLSLDSNVLLMDLCAAFVHLLHKVEKLEGK

SEQ ID NO: 50 - protein, 1051 aa, Artificial sequence
  Synthetic: STF-48
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSQLESDADGMGDALVAVKQPYIGSIALTQHDKNTNFISAKDFGATADGTLHPLSEKFSTLSAAQAVYPFVTSLTQSLDYAGIQAAINTGRNVLLTSGTYFVNATIEMNSNCTINGETNSNINRPETFIAVIGNIACFHYHAAFNTINIENVYIFYDGGRPTSPTGNDGKIGILIDGGTTSPGVMHIKNVEVDGAWWAIYDDSGNYLTKYTQVWARRVAHGFYKANGTTIQWDTCYVLDAAQAWYVVNCLSPQLINCAGDQITVDGSQYTFDSSGLYFSGCKCLTITGYDGESNIIKNTNGITASYIKLNDTIAHISGLAGHGNSMQTTGSGTAAFIFATGTSIVNIKSSTDSFLDSESITYTGSGYPNTLLTDSTAKIIAEGCRFKAPTGGTPVISTYSTGNGVFTDCSLTGTQTSGSYVESRSSAGNQLPAVYTAKGTQAVAANVATTLFELPNSQGMYLISVWAESSGTNFSSLQLAMWDGTTLTLTPLKSGGLISFTVTGRIVTITSQGTTTFNWTYTKAG

SEQ ID NO: 51 - protein, 1365 aa, Artificial sequence
  Synthetic: STF-49
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGAIGDGVHDDTSALSELLSVATGGEKIDGRGLTFKVSTLPDVSRFKNARFLFERIPGQPLFYASEDFIQGELFKITDTPWYNAWTQDKTFVYDNVIYAPFMAGDRHGVNNLHVAWVRSGDDGRTWTTPEWLTDLHENYPTVNYHCMSMGVVRNRLFAVIETRTVSGNKLQVAELWDRPMSRSLRAYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTRGTLSTQPGSSLHRSSDLGTSWNSLRFPNNVHHSNLPFAKVGDELIIFGSERAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDFVYGATPNRTLPTFMSTSGVRTVPVPVDFTDDVAVQSLTVHAGTSGQVRAEVKLEGNYAIIAKKVPSDDVTAQRLIVSGGETTSSADGAMITLHGSGSSTPRRAVYNALEHLFENGDVKPYLDNVNALGGPGNRFSTVYLGSNPVVTSDGTLKTEPVSPDEALLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVMEDIIERVEITPAGSRWGVRPDLLFYIEAAWQRREIERIKARLDLIEGKH

SEQ ID NO: 52 - protein, 1051 aa, Artificial sequence
  Synthetic: STF-52
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSQLASSEDGMGDALVAVKQPYIGSIALTQHDKNTNFISAKDFGATADGTLHPLSEKFSTLSAAQAVYPFVTSLTQSLDYAGIQAAINTGRNVLLTSGTYFVNATIEMNSNCTINGETNSNINRPETFIAVIGNIACFHYHAAFNTINIENVYIFYDGGRPTSPTGNDGKIGILIDGGTTSPGVMHIKNVEVDGAWWAIYDDSGNYLTKYTQVWARRVAHGFYKANGTTIQWDTCYVLDAAQAWYVVNCLSPQLINCAGDQITVDGSQYTFDSSGLYFSGCKCLTITGYDGESNIIKNTNGITASYIKLNDTIAHISGLAGHGNSMQTTGSGTAAFIFATGTSIVNIKSSTDSFLDSESITYTGSGYPNTLLTDSTAKIIAEGCRFKAPTGGTPVISTYSTGNGVFTDCSLTGTQTSGSYVESRSSAGNQLPAVYTAKGTQAVAANVATTLFELPNSQGMYLISVWAESSGTNFSSLQLAMWDGTTLTLTPLKSGGLISFTVTGRIVTITSQGTTTFNWTYTKAG

SEQ ID NO: 53 - protein, 931 aa, Artificial sequence
  Synthetic: 1AR
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSIATRVSKEGDTMTGKLTLSAGNDALVLTAGEGASSHIRSDVGGTNNWYIGKGSGDNGLGFYSYITQGGVYITNNGEIALSPQGQGTFNFNRDRLHINGTQWTAHQGGGWENQWNQEAPIFIDFGNVGNDSYYPIIKGKSGITNEGYISGVDFGMRRITNTWAQGIIRVGNQENGSDPQAIYEFHHNGVLYVPNMVKTGARLSAGGGDPVWQGACVVIGDNDTGLVHGGDGRINMVANGMHIASWSSAYHLHEGLWDTTGALWTEQGRAIISFGHLVQQSDAYSTFVRDVYVRSDIRVKKDLVKFENASEKLSKINGYTYMQKRGLDEEGNQKWEPNAGLIAQEVQAILPELVEGDPDGEALLRLNYNGVIGLNTAAINEHTAEIAELKSEIEELKKIVKSLLK

SEQ ID NO: 54 - protein, 259 aa, Artificial sequence
  Synthetic: 1AR-AP1
MAVTGPWVGSSAVVNTGQNWMVGAAQRLRMGAPFWMSNMIGRSVEVIHTLGADHNFNGQWFRDRCFEAGSAPIVFNITGDLVSYSRDVPLFFMYGDTPNEYVQLNIHGVTMYGRGGNGWAAGAIGASDGGVCIQNDIGGRLRINNGGAIAGGGGGGGGYSQANNWAGKYVCGGGGGRPFGLGGNNGARWPGGNASLTSPGAGGNTGTRYYAGGGGEVGQPGQYANPGAGYSTPPTSPGAAVAGSAPTWQNVGAIYGPRV

SEQ ID NO: 55 - protein, 80 aa, Artificial sequence
  Synthetic: 1AR-AP2
MSEQTIEQKLSAEIVTLKSRILDTQDQAARLMEESKILQGTLAEIARAVGITGDTIKVEEIVEAVKNLTAESTDEAKDEE

SEQ ID NO: 56 - protein, 901 aa, Artificial sequence
  Synthetic: 13-13.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 57 - protein, 259 aa, Artificial sequence
  Synthetic: 13-13.0-AP1
MAVVGVPGWIGSSAVNETGQRWMSQAAGQLRLGVPCWMSQFAGRSREIIHTLGADHNFNGQWFRDRCFEAGSTPIVFNITGDLVSYSKDVPLFFMYGDTPNEYVQLNIHGVTMYGRGGNGGSNSPGSAGGHCIQNDIGGRLRINNGGAIAGGGGGGGGGRYGRLSFGGGGGRPFGAGGSSSHMSSGATAGTISAPGAGSVGEGSLWVYTGGSGGNVGAAGGRCNIQGNGTEYDGGAAGYAVIGSAPTWINVGAIYGPRV

SEQ ID NO: 58 - protein, 80 aa, Artificial sequence
  Synthetic: 13-13.0-AP2
MSEQTIEQKLSAEIVTLKSRILDTQDQAARLMEESKILQGTLAEIARAVGITGDTIKVEEIVEAVKNLTAESADEAKDEE

SEQ ID NO: 59 - protein, 761 aa, Artificial sequence
  Synthetic: 13-14.3
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 60 - protein, 259 aa, Artificial sequence; identical to SEQ ID NO: 57
  Synthetic: 13-14.3-AP1

SEQ ID NO: 61 - protein, 80 aa, Artificial sequence; identical to SEQ ID NO: 58
  Synthetic: 13-14.3-AP2

SEQ ID NO: 62 - DNA, 2058 bp, Artificial sequence
  Synthetic: STF-25
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacagcagcggcatcgtccaggaacgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgagctgaaaaggcggcagaccgcgcagaagccgcagcggaagtgactgcagagccctgtgcgaatatagtgccgccgctgcctgatgtgtggataccgtttaacgattcactggatatgattgcgggtttttctccgggctataaaaaaatagctattggtgacgatgtggttcaggtcgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaactacatgctcaattcggaaagtccagccagctgggggaagtcatcaaacatggatgtgcccgaaaccgggacggatagttttggttttacttatggaaagtttgtctgcaacgattctctggttgggcaaacttcggctattaatatggcatcaattgctgcaacaaagtcagttgatgtctcaggcgataacaagtacgtgacaacctcatgccgttttaaaacagaacgacaggtaaggttacgtatacggtttgataagtatgatggtagtgcaacaacttttcttggcgatgcgtacattgatacgcaaacgcttgaaattagtatgacaggtggtgctgccggcagaattacggcacgagtcaggaaggataagaccacgggctggatttttgcagaggcaacgattcaggcaattgatggtgagttaaaaataggctctcagatacagtattctcctgggcagggtggggcaacagtatctggtgactatatttatcttgccaccccacaagtagagaatgggccgtgtgtatcatcatttattatttcaggaggcagcgcaacgacaagagccagtgatttggttagtatccccaccagaaataatctttataagttaccatttacttttttacttgagattcataaaaactgggatattgcaccaaacgccgcaccccgcgtgtgggatatagcagcagccaataccgggcaatcagcaattgcagcaatcaacagaggtagtggtaagttatatatgagtctgtcaaacccttcaggctcgtatgttaatagcgcagcgacagatgtatttgcagagaaaaccacatttggatgtattgcaaaagctgatggtcactttcatgtggtgacaaatggtaaagcggttaatgaagtttattgtgaatataatggcgtgaccgctgataaaaatatccgatttggagggcagacgaatactggagaacgacatctgtttggccatattcgcaatttccgcatatggcataaagaattaaatgacaggcaattaaaagaggtcgta

SEQ ID NO: 63 - DNA, 276 bp, Artificial sequence
  Synthetic: STF25-AP1
atgaaagatttaactttgaagtttcatgacaaactgcagtttaaggccttcctgtcatctcttggctgggcggaagatgaagacctccagaataaactgttagttgatgaaattggtttcacctacacagaaacaggggtaacagaagagggagaacctgtctgtatccggaatgatggttattttgtcaacattcgcattcttgatgacttgtttgatgtttctgtattctctgattatgtcgtggagctggaaacaccgcttcgggaatggagc

SEQ ID NO: 64 - DNA, 2061 bp, Artificial sequence
  Synthetic: STF-27
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccagcgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaacttcttccagaacagtacagacccttcgaagtggaataagtcaacttcactggacgttacagaaacaggcacagatagtttcgggtttaattatggtcggtttgtcgtacaggattcgattgttggtacaagtaaagcgcataccattatcggactgtattcgagtaccggaggggttgatacttcaggggacgaaaagcatgtaactatatcctgtcgggtaaaaagtgaagttgataatatcgccgttcgtattttatttgaacattatgatggggaggtaaggacatcaataggagcagcaaacctgaaccttaccacccgcataattagcaagacaggtcagacaagccgtgttacagcaaggtctgttaaggatgatgcaactggctggatattttttgaggctacattaaaagcagatacaacagaaaatacggttggtggttttgtccagtattctccggatacagggcagatggttacatcaggggattatctcgatgtaaccactccacagattgaggctggtacaggcgcatcatcttttattgttacggggacggcaccggcaacgcgggcaagcgatatggtgacagtcccaatcaagaataacctttataatcttccttttacggttctttgtgaggtacataagaactggtataaaacgccaaatgtagcgccgcgtgtttttgataccggcggtcatcaaaccggagcggggatcgtaatggggtttggttcatcaggtgggtacgacggttttccgtattgcgatataggtggttcagaccgacgaataaatgaaaatgccgggctggaaaaaatgcttattggtatgcgggtaaagtccgaacggtccacatgtgtagtcagtaacggtaagttaagcagcgaaactaaaaccaaatgggaatatatccggagtacagcaaccattcgcattggtggacaaactacagcaggattacgccatttatttgggcatgtgaggaattttcgtctctggcataaagagctaacagatgcgcagcttggggaggttgtggag

SEQ ID NO: 65 - DNA, 276 bp, Artificial sequence
  Synthetic: STF27-AP1
gtgagagatttcacgttgcgtttcagtgataaagcagatttcagggcatttctcaggaaacttaactgggaagaggacgaagagctgcagaatgccgttctggttgatgagattggttttacgttcagggagacagatgtttctgatgacggagaaccagaatacacgcgaaacgaagggtactttgttaatatccgtcttcttgacgatggatttgaggattccgtgttccgtgagtgggtggttacaccagagcgcccgctcagggagtggttt

SEQ ID NO: 66 - DNA, 264 bp, Artificial sequence
  Synthetic: STF27-AP2
atgctgccgcagcatagcgatattgaaatagcctggtatgcttcgatacagcaggagccgaatggctggaagaccgtcaccacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcaactgcacctgatattgagtggccgacttcacctgcagag

SEQ ID NO: 67 - DNA, 2019 bp, Artificial sequence
  Synthetic: STF-28
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacagcagcggcatcgtccaggaacgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgagctgaaaaggcggcagaccgcgcagaatccgcagcggaagtgactgcagagccctgtgcgaatatagtgccgccgctgcctgatgtgtggataccgtttaacgattcgctggatatgattacgggtttttcgccatcttataaaaagattgttattggtgacgatgaaataacaatgccaggcgacaagattgttaagtttaaacgtgcttcaacagcaacgtatattaataagtccggccaactcaagcttgctgaagttgacgaaccgcgatttgagcgcgatggcttattgattgaaggacagaggacaaattatctgaggaactcaaataaaccagactcatggactgttcattccgcactgaataaaacatttggcactgataaacaggggttcaattatgccacggtgacacccacggaaagtatagtgggaacaacaggtggctatactgtgcatggtgtggttgcagcagacagattcccgctggcaagtggtgaatgtttcactttttcgtgccgggttaaaggcgctaaagcacgatgcaggttaagagtttcagttattattggtggaacagatacattctctgctgactcttatcttgatctggatacccggatcgcaacagtaagcggtaatacatcccttataacagccaaagctgaacaacagggcgagtggacctactatgaggccacttatacagctaatacggacattgataccgttaactgtgctttttatatgacaaataaaataagtaatgagccattctatgatgactcaacattaaccatgacgacgccgcaaattgaactgggcaatacggcatcgtcatttattgtaactacaatgccaacaacacgcgcaagtgatgtggttactatcccctcggcgaataacctgtcaacacggccttttacagtattgtgcgaagtaaggaggaactggagtacaccgcccaatgttgcgccaaggatatttgatgttggagggcacagtattgatgataattatttatcgctggggtttgtttcaacaggaaagataagcgccaacgtaggaatggttcagccacaaatttcctcagatggagaaaggttcattgtgggtgtgagagctaaatctgatttatcagtaaatgcaatatgcaatggtaattatacaacaaaccttaatggtaaaatatttggagttacagcaacatcgtaccggtttggtgggcagaccgcagcaggaacgcgtcatttgtttggacacatcagaaatttcagagtctggtttaaagaattaaatgacaggcaaatcaaggaggcagta

SEQ ID NO: 68 - DNA, 276 bp, Artificial sequence
  Synthetic: STF28-AP1
atgaaagatttaactttgaaatttcctggtaacagagagtttaaatccttcctgtcatctcttgactgggaggaagatgaagacctccagaataaactgttagtcgatgaaattggtttcacctacacagaaacaggggtaactgaagagggagaacctgtctgtatccggaataacggttattttgtcaacattcgcattcttgatgacttgtttgatgtttctgtattctctgattatgtcgtggagctggaaacaccgcttcgggaatggagc

SEQ ID NO: 69 - DNA, 2394 bp, Artificial sequence
  Synthetic: STF-15
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgcaactgcatcagctaacagtcaaaaagcagcaaaaaccagtgaaaccaacgcaaaggtgagcgaaacagcggctgcgaactcagcgaaagcatcggcagcaagccagacggcagctaaagcaagcgaagatgcagccagagagtatgcaagtcaggcagcagagccgtataaatatgtcttacagccactgcctgatgtgtggataccgtttaacgattcactggatatgattacgggcttttcgccgtcatataaaaaaattgttattggtgatgatgaaataacgatgcctggcgacaaggttgttaagtttaaacgcgcatcaactgccacatatatcaataaatcaggcgtatttagtgttgctaaaattgatgagccacgatttgaaaaagaaggtttattgattgaaggacagcgcactaactattttgttaaatccaatactcccgctgaatggacgagtaccagcaatatcgataaaactaataatggtgttgatgaatttggtttttcatatgccaaaatgcgaacaaaagataatatgacaggacaatcatctgcacttagtctgcatagatgcagtgcatcccgggggattgatgttagtggcgataataagtattgcactgtttcatgcagggttaaagctcctgatggtcttcgttgtcgtttgcgttttgaaaaatacgatgggtcggtttatacatttttaggagatgcttatttaactttcggaactctgataatagaaaaaactggcggggcagccaatagaatagcagctactgcaactaaagatccggttacagggtggattttctatgaggcaactatagaagctgttgaaggtgaaaccttaattggcgcaatgattcagtatgcgccgaaaaaaggtggtataactgaagcgggagattatatttaccttgcaacaccacaatttgaaaacggcggatgtgcttcatcttttgttattacgacaactgcacccgcaacccgctccagtgatatggtgacgattccaactaaaaataatatctataatagaccgcttacgtgtcttgtcgaggttaatagaatttggggcgatattcctcctaatgtagcaccgcgtatttttgatttttctggtgtgccacctattgagtcaattacatacgcttttaacacaactgagaaatattacggtcagctttatatgcaaacttataaagcgtcgacaagtacttacgtttctagtgtgtttgctggtcgagctgatgttcgaaaattcattggtggttttaatatttattctgatggtactaaacgagtagtttctaacggtgaggctactaaaactatgaaaacggagtggacgggcgtaaaaacacggacctttattcgaattggaggtcaagccacatcgggaactcgtcatctattcggccatttgagaaatcttcgtctctggcataaagaattaactgatgcgcaaatgggggagagtattaaa

SEQ ID NO: 70 - DNA, 279 bp, Artificial sequence
  Synthetic: STF15-AP1
atgaaagatttaacactcaaatttgcagacagggccgacttttcggcctttatggagagcattggctattatgatgacgagtcgatgcaggatgatattcttattgacgtgataggtaatgtgtacaaagaaaccggagaacttactgaagatggcgagccggcatgtgttaaggaggacggatattttgtaaatgtgcgcatcattaatgattcgcaaatatcgtcattattcgatgaacacgcggttgctgttgagcatcaactccgtagctggatg

SEQ ID NO: 71 - DNA, 702 bp, Artificial sequence
  Synthetic: STF15-AP2
atggctacatcgacagtaattcctgatgacatcaaaacgctaaagggagatgtcagtaaggcaaaggaagatatttcctcaattaacgtaaaagtatcaacgcttcagactgatatggacagtgcaaagcaggatatcagtaccagatacacaaaaacagaagtggataataagctgaaaaacaaagtggaagtgaacgatctggaaagtggtcgttatggcggagatttttacccgctgactggccgtgaagcgttttatttatggggattgggcacaactacagcggcggcaaatctttatcttaatcctgaccctgcaatttcgtctgtgctgcggtcaacatcgtctatccgctataaacattcagtagagacgatagattcagagcacgccgatctcattttcaggatgcgccctgtgtggtacaggtcgcaatgcgaaaatgacaggcgtgactggggattctatggattgattgccgaggaagtaggagaaattgcccctcagtttgttcactggcgaccagccaacgaagatgatgcaccggaaaccatttccagcaatggccttgttgccgaaggtgtaatgtacgaacgtctggttgttccactgattcaccatatccagaaactgactgaaagagttgatgaacttgagtcagaattgaagttgttatcaacttcccaaagcgatatcgga

SEQ ID NO: 72 - DNA, 2373 bp, Artificial sequence
  Synthetic: STF-16
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatcagccaacagtcaaaaagcagcaaaaaccagtgaaaccaatgcaaagacaagcgagactgcagcggcgaactcggcgaaagcatccgctgcaagccagaccgctgcaaaagcaagtgaagacgcagccagagagtatgcaagccaggcagcagatccgtataaatatgtcttacagccgctgcctgatgtgtggataccgtttaacgattcactggatatgattacgggcttttcgccatcatataaaaagattgttattggtgacgacgaaataacgatgcctggcgacaagattgttaagtttaaacgtgcatcgaaagcaacctatattaacaaatctggtgtgctgacagaggctgccattgatgagccacgatttgaacgtgatggcctgcttattgaggggcaaagaactaatcttctgcttaattcaacaaatccatctaaatggaataagtcaggcaatctggaactcacagaaatatccacggattcttttaattttacttatgggagatttactgtaaaagatactcttattggtcagacaagtgctattaatatcgtaacgatttctggcagtaaagggtttgatgtcacaggtgatgaaaaatatgtgaccatttcatgccgtgtaagaagtgatgttgaaaatataaggtgtcgtttaagatttgaacaccatgatggttatacttacacttttttgggagatgcttacctcaatttatcaacacttgtaattgataaaactggtactgctgcagaccgtattattgcaaaggctgtaaaagatgaggttactggttggattttctatcaggctacaattaatgcactagatacagagagcatgattggtgcgatggttcaatacgctcctgtaaaaggttcaggtacagcatctggagactatctggatatcgcaactccacaagtggaaggtggatcaagtgcttcgtcatttattgtaactgatataactgcaagcactcgcgcaagcgatatggtgacagtcccaatcaagaataacctttataatcttccttttacggttctttgtgaggtacataagaactggtataaaacgccaaatgcagcaccgcgtgtttttgataccggcggtcatcaaaccggagcggctattattcttggcttcggtcgttcaacagattacgacggatttccttattgtgatataggtttggctaacagacgggtaaacgaaaacgcatcgcttgaaaaaatggttatggggatgcgtgtaaagtcagatcagtctacgtgctcagtaagtaacgggcgtatatccagcgaaaagaaagccacatggtcctatattcagaactccgcaattatccgtattggaggccagactacagccgggttgcgtcatttatttggtcatgtcaggaatttcagaatatggcacaaggcattgactgatgctcagatgggggagtcaatc

SEQ ID NO: 73 - DNA, 279 bp, Artificial sequence
  Synthetic: STF16-AP1
atgaaagatttaacactcaaatttgcagacagggccgacttttcggcctttatggatagcattggctattatgatgacgagtcgatgcaggatgatattcttattgacgtgataggtaacgtgtacaaagaaaccggagaactgactgaagatggcgaaccggtatgtgttaaggaagatggatattatgtaaacgtgcgcatcattaatgatgcaaaaaaatcgtcaatattcgatgaatacgcggttgtagttgaacatcaacttcgtggctggatg

SEQ ID NO: 74 - DNA, 702 bp, Artificial sequence
  Synthetic: STF16-AP2
atggctacatcgacagtaattccaggagacatcaccacgttaaagggagatgtcagtaaagccaaggaagatatttcctcaattaacggaaaagtatcaacgcttcaggctgatatgaccagtgcaaagcaggatatcagcaccagatacacaaaaactgaagttgataataagctgaaaaacaaactggaagtgaacgctctggaaagcggtcgttatggtggagatttttacccgttgactggccgtgaagcgttttatttgtggggattgggcacgactacagcggcggcaaacctttatcttaatcctgaccccgcaatttcgtctgtgctgcggtcaacatcgtctatccgctataaacattcagtagagacaatagattcagagcacgccgatctcattttcaggatgcgccctgtgtggtacaggtcacaatgcgaaaatgacaggcgtgactggggattctacggattgattgccgaggaagtaggagaaattgcccctcagtttgtacactggcgaccagctaacgaagatgatgcaccggaagctatttccagcaatggccttgttgccgaaggtgtaatgtacgaacgtctggttgttccactgattcaccatatccagaagctgactgaaagagttgatgaacttgagtcagaattaaagttgttatccgtttcccgaagcgatatcgga

SEQ ID NO: 75 - DNA, 2373 bp, Artificial sequence; identical to SEQ ID NO: 72
  Synthetic: STF-17

SEQ ID NO: 76 - DNA, 279 bp, Artificial sequence; identical to SEQ ID NO: 73
  Synthetic: STF17-AP1

SEQ ID NO: 77 - DNA, 2374 bp, Artificial sequence
  Synthetic: STF-13
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcatcttctgccactgcatcagccaacagtcaaaaagctgcaaaaaccagtgaaaccaacgcaaaggcgagcgagactgcggcggctaactcggcgaaagcatccgctgcaagccagacggctgcaaaagcaagtgaagacgcagccagagagtatgcaagccaggctgcggagccgtataaacaagttttgcagccgcttcccgatgtgtggataccgtttaacgattcactggatatgcttgctggcttttcgcctggttataagcaaataactgtaggtgatgatgttattaaaatgccatccgataaggttgttagcttcaaacgcgcatcaggtgcaacatacattaataaatcaggagtattaaccgttgctgaagttgacgaaccgcgatttgaacgagaaggtttgctgattgaaggacaaagaaccaactatcatcttaattcacttacgccatctaagtggggagctacaacaagtgtaactataacagaaagtggtgttgatgagtttggctttacttatgggcggtttcaaataaaggacgaaaaaattgggacaaatacgacaatgaatatcgctgcggtttcaggaggaagaggtgtcgatgttactggaactgaaaagtatgttacaacatcatgtcgtgtaaaaagcgatagtgctaatatacaatgtcgtataagatttgaaagatatgacgggtccgcatatttttatctggcagatgcatatcttaatataacagatatgtccattaggaaaacgggaggaggggctgcaagaataaccgcccgagcggagaaagaatctaatggatggatttatttcgaggttacatatcaatctgaagctattgataatatggtgtggctctcagatccaaattgctccacctgtttcacctggaacttatttgggcggggaatatttggatgttacgacaccacaatttgaaggcggctcatgcgcatcatcttttatcatttccgatacagttgcatcaacgcgagcaagcgatattgttacattgccttgtaaaaataacatggccagcaaacctttaacctgcatggttgaagtgaataaaaattggtctatagcaccaaattccgcgcctagaatttatgatataacaggatttaaaacaaaagacgacgcttttgtttttgcattcagaaatacagcaggtagtgtaggaactccatatgttcaatttggtaatccaatatcatttccacctggaaattacccaagaaagattatcgctgtatatagaataaaaagcgatggcaagtttcaggctggctgcaatggggttttatcaacaccagcatcaacaacgtggaagagtgttagtggtgctacaggtataaggattggaggccagactacagccggcttacgtcatttatttggttatatcaggaattttagaatatggcataaagaattaaccgatgcgcaaatgggagagataata

SEQ ID NO: 78 - DNA, 279 bp, Artificial sequence
  Synthetic: STF13-AP1
atgcgagatttaattatcaaattcacagacaaggccgacttttcggcctttatgaagagtgctggctattatgatgacgagtcgatgcaggatgatattcttattgacgtgataggtaacgtgtacaaagaaaccggagaacttactgaagatggcgagccggtatgtgttaaggaagacggatattttgtaaacgtgcgcatcattaatgatgcaaaaaaatcgtcaatattcgataaatacgcggttgttgttgagcatcaacttcgtggctggatg

SEQ ID NO: 79 - DNA, 702 bp, Artificial sequence
  Synthetic: STF13-AP2
atggctacatcgacagtaattccaggagatatcaccaagctaaagggggatgtcagtaaagctaaggaagatatttcatcaattagcagaaaagtatcaacgcttcagactgagatgaccagtgcaaagcaggatatcagctccagatacacaaaaactgaagttgataataagctgaaaaacaaagtggaagtgaacgatctggaaagtggtcgttatggcggagatttttatccactgacaggtcgtgaagcgttttatttatggaatttggccacgactacagcggcggcaaacctttatcttaatcctgaccctgcaatttcgtctgtgctgcggtcaacatcgtctatccgctataaacattcagtagagacaatagattcagagcacgccgatctcattttcaggatgcgccctgtgtggtacaggtcgcaatgcgaaaatgacaggcgtgactggggattctacggattgattgccgaggaagtaggagaaattgctcctcagtttgtacactggcgaccagctaacgaagatgatgctcctgaagctatttccagcaatggccttgttgccgaaggtgtaatgtacgaacgtctggttgttccactgattcaccatatccagaaactgactgaaagagttgatgaacttgagtcagaattaaagttgttattaacttcccgaagcgatattaga

SEQ ID NO: 80 - DNA, 2343 bp, Artificial sequence
  Synthetic: STF-12
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatcagcaaacagtcaaaaagctgcaaaaaccagtgaaaccaatgcaaagacaagcgagactgcagcggcgaactcggcgcaagcatcggcagcaagccagacagcagctaaagcaagtgaggatgcagccagagagtatgcaagccaggcagcagagccgtataaatatgtcttacagccactgcctgatgtgtggataccgtttaacgattcactggatatgcttgctggcttttcgcctggttataagcaaataaccgtaggtgatgatgttattaaaatgccatccgataaggttgttagcttcaaacgcgcatcaggtgcaacatacattaataaatcaggtgtattaaccgttgctgaagttgacgaaccgcgatttgaacgagaaggtttgctgattgaaggacagagaacaaactatttcagaaattcaaatacaccagaagcatggaataacacgggtagtgtgtctgttgagtcgttcgacagtgataaggggtttaactatggaaggataactgttattaatgaaaatccgacagcacaaggatatcaggcaattgctgtaaacacgaatgatgcttacacctgcccggcaggttcttatacgacgatatcgtgtctgacgaaaagtgataattcccggtgtcgtgcaaggttcggaaaaatgtctgataatggtgcgtttgtttttcattcagatgcagttctggatcctgttacgggaaatgttgttcatggaaataatgtgacggtgacggcagaaagagtcggtgaatggtggttgtttaccgccactctttttgcagatgcggaaatgataatcagctcaagatttgaaatcctggcgatgcctggaatcagtattatccccaatggctctacgttagatattgcgatgcctcaggcggagattgggtcgtacaggacgtcatttatcattactgaaggggctcctggcactcgctccagcgacatggtgacaatacctgtaagaaacaatattcaccgattaccattcagtgctcttgttgaagttaataaaaactgggatatccctcccagcaaatcaccattaatctttaatgttaaagattatcaggaaaatggtctgttcacgcatggattccgtggtaataatttctctgatgccggttctccttttatttctatgggagggtgtaataaatatgtggcaacaacccagaggaaaatcatttcaggcttccgttgtggcgctgatggagatgttcaggccgtatgtaatggtgaattatctgttgcggcaaaaacaacatggacttcaattgttccacgggcagtattgcgaattggagggcagggcactaatggggagtatcatctttttggtcatatccgtaatctgcgtatctggcataaagaattaactgatgcgcaaatgggggagagtattaaa

SEQ ID NO: 81 - DNA, 279 bp, Artificial sequence
  Synthetic: STF12-AP1
atgaaagatttaacactcaaatttgcagacagggccgacttttcggcctttatggagagtattggctattatgatgacgagtcgatgcaggatgatattcttattgacgtgataggtaacgtgtacaaagaaaccggagaactgactgaagatggcgaaccggtatgtgttaaggaagacggatattttgtaaacgtgcgcatcattaatgatgtaaaaaaatcgtcaatattcgataaatacgcggttgttgttgagcatcaacttcgtggctggatg

SEQ ID NO: 82 - DNA, 702 bp, Artificial sequence
  Synthetic: STF12-AP2
atggctacatcgacagtaattccaggagatatcaccacgctaaagggagatgtcagtaaaactaaggaagatatttcctcaattaacggaaaagtatcaacgcttcagactgatatgaccagtgcaaagcaggatatcagcaccagatacacaaaaactgaagttgataataagctgaaaaacaaactggaagtgaacgatctggaaagcggtcgttatggtggagatttttacccgttgactggccgtgaagcgttttatatgtggggattgggcacgactacagcggcggcaaacctttatcttaatcctgaccctgcaatttcgtctgtactgcggtcaacatcgtctattcgctataaacattcagtagagacgatagattcagagcacgccgatctcattttcaggatgcgccctgtgtggtacaggtcgcaatgcgaaaatgacaggcgtgactggggattctacggattgattgccgaggaagtaggagaaattgcccctcagtttgtacactggcgaccagctaacgaagatgatgctcctgaagctatttccagcaatggccttgttgccgaaggtgtaatgtacgaacgtctggttgttccactgattcaccatatccagaagctgactgaaagagttgatgaacttgagtcagaattaaagttgttatccgtttcccgaagcgatatcgga

SEQ ID NO: 83 - DNA, 3777 bp, Artificial sequence
  Synthetic: STF-63
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcaaattccgcgacagcagccaaaaaatcagaaaccaacgcgaaaaatagtgagtcagcagcaaaggtcagcgaaaccaacgctaaagcgtcagagaacaaggcgaaagaatatctcgacaaggtcgggggactcgtcagcccgatgacgcaatacgattggcccgttgttactggtaatgagtctttttacataaagatcgcgaaactttccgatcccggaagcaacaattgccatgtaacgctaatggttactaacggcggtgactacggctccccttacggaaacattgactttatcgagatctcggcgcgcggtctgccttcttcgcttactgctgataatgtatctcgttacctgagtatacgccgtttagggccaaccgggctaatcaatagcatgcaaatgcgttacggcctggttaaagatgatggctttattgaggtttgggccttccagcgtgcatttatcaacggcgcaaaggttgcggtactggcgcagacggcacgcacggaattatacattccagacggatttgttaagcaaaccgccgcgccttctggatatgttgaaagccccgttgtaaggatttacgaccagttaaacaagccgactaaagcagatttgggtctttctaatgctatgcttacaggcgctttcggtcttggcggtagcgggatatcaacaaacggcaagatgagcgatgtagagatcttaaaagctctgcgtgacaaaggtggtcatttctggcgcggtgataagccgaccggaagcacggcgaccatttatagccacggttctggtatattctcgcggtgcggcgatacgtggtcagcgatcaatatcgactactcaaccgcgaagattaagatctatgccggcaacgatgcccggcttaacaacgggacttttagcatcaatgagctatacggctcggcaaacaagccgtcgaaatcggatgttggacttggcaacgtaacgaacgatgcgcaggtaaaaaaaaccggcgatacaatgaccggtgacttgacaatcaaaaaaggtacaccgtcagtcttcctgcgggcagacagtggagtcaccgctttgcggttttatactggcgataacacagagcgcggcataatctatgctggtcctaacactgattcgcttggcgaagttcgcatcagggcaaagacagcaggggggacatcaggaggggatcttgttgttcgtcacgacgggagggttgaagtccgtgatctcacagtagcgtataaaattaaaagcagaacgattgagattgcaaataccgatactgactcatcggcaactacgctcagcatctatggagtacagcacacgccgttggttttaacgcgttctggttcttctgaaaatgtgtccattgggtttaagttagacaacatgaacccaaagtatcttggaattgatactaatggggatctggcttttggtgagagtcctgatcagaaacaaaacagcaaattgatcacgcaagcgaaactcgacaagggattaacgattggtggtcaactggctttcaaaggtacgacagcgttttcagccgttgctacgttcattgccgggatagcaggagccatcgagccggaaaacattgacggccagacggttaatcttaacaacctgaccatcatcaagtcagatgccggggcagttaaatactatatttgtccatcctctgcaggtggtgcaaatattaccaataagcctgacggcatagccggtaactttttgctccgtgtagagtcgactcgtaaggttagggattcagattatgcgaacatgcaaacgctgattaacagcgacacaaaacgtatatacgttcgctttgttgttaatggaaactggacagcgtggagtcaggttgttgtttccggatggaatcaggatataactgtcaggtcgttaaccacatctagtccggtaaaatctggcggagggcgaattgatgtccttggaagcacgtcagactatagcaaaatggattgctttgtacgtgggtttgatagcaccggtaattctctcgcgtgggcgttgggttcatcagccggcgtaagtaagatgctgtcgctaaaaaatttctttagcggagctgagatactgttaaatggtaatgacggcacggttcaactcaaaacaggtgctgttaacggggctacagcgcaggcgctcactatcaacaggaatgaggttaactcaactgttgatttaacccttacaaaacaatcagggactggcaatcgttttgttttacagaactcaggtaatgcagaactaccgttttctgtcagggtgtggggttccagtactcgacaaaacgtttttgaggttggcacgtctgctgcgtatctgttttatgcgcaaaaaacgtcagcaggccagttgtttgatgtaaatggcgctattaattgcacaacgctgaatcagtcatcagaccgcgaccttaaagacgatattctcgttatcagcgacgcgacgaaagcaatccgtaaaatgaacggatacacctacacgctcagggaaaacgggatgccttatgctggcgttattgcacaggaagtaatggaggcgataccagaagctgtgggatcgtttactcattatggtgaagagttgcaaggtccgaccgttgacggcaacgagctacgcgaagaaacgcgctatcttaatgttgactacgccgccgtgacgggcttacttgttcagttcgcccgtgaaacagatgatcgcgttaccgcgctggaagaggaaaacacaacgctacgtcaaaatctggcaacagcagacacccggatcagcactctggaaaatcaggtaagcgaactggttgcacttgtccggcagttaacaggaagcgaacattga

SEQ ID NO: 84 - DNA, 3762 bp, Artificial sequence
  Synthetic: STF-62
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcaaactccgcgacagcagccaaaaaatcagaaaccaacgcgaaaaatagtgaggcagcagcaaaggtcagcgaaaccaacgctaaagcgtcagagaacaaggcgaaagaatatctcgacaaggtcgggggactcgtcagcccgatgacgcaatacgattggcctgttgttactgctagtgagtctctttacatcaagatcgcgaaactttccgatcctggaaccagcagaagtcatgtaacgctaatggttactaacgctggtaactacggctccccttacggaaacattgactttatcgagatctcggcgcgcggtctgccttctttgcttagtgcggataatgtttctcgtcatctgagtatacgccgcttagggtcaaccgggctgaccgataacaaccagatgcgttacggcctggttaaaggtgacggctttattgaggtttgggcattccagggtgcgtttattaacgacgcaaaggttgcggtgctggcgcagacaacactaaacacagaattatacattccagacggatttgttaagcaaaccgccgcgccttctggatatattgaaggcaacgttgtaaggatttacgaccaggtaaacaagccgactaaagcagatttgggtctttctaatgctatgcttacaggcgctttcggtcttggcggtagcgggatatcaacaaacggcaagatgagcgatgtagagatcttaaaagctctgcgtgacaaaggtggtcatttctggcgcggtgataagccgaccggaagcacggcgaccatttatagccacggttctggtatattctcgcggtgcggcgatacgtggtcagcgatcaatatcgactactcaaccgcgaagattaagatctatgccggcaacgatgcccggcttaacaacgggacttttagcgtcaatgagctatacggctcggcaaacaagccgtcgaaatcggatgttggacttggcaacgtaacgaacgatgcgcaggtgaaaaaatccggcgatgttatgtctggtgatcttgatatattgaaagaaacgccatctatcaggctaaaatcagcaaaaggaaccgctcatctgtggttcatgaacaacgacggaagcgagcgcggcgttgtttggtcgcctgaaaacaacgaatcacttggcgaaatccacatcagggcgaaaaacacaaaaggtgaatcaagtggtgattttattgttcgccacgacgggagggttgaggcccgcaatctaaaaataacttacaaaatcagcgcagccaccgcagaatttgcaaacacaagcaccagttccgataacactacggtaagcatcaaaggatctcagcatacgcctttggttttaacgagcaacaacacaattaaaaacttgtccattgggtttaaggttgatgatgttgatcaaaaatacctaggtatagctggtgacggtgatttgtattttggtagttattctgaccacacaaaaaacagcaaagtaatcacacaagcaaaactcgatagcggggtgacggtaggcggtaaaacaaccttttctgaccttgccacatttaacgcaggtatggcgggatctatcgagccggaaaccattgacaacaagactattgatttaaacgacttgatcattgctaatacagtggctggatctgttaaatactatcaatgcaaaactgtcgcaggtggtgcatatattaccaataagcctgacggcgtaagcggtaactttttgctacgtgtagaatctactcgtaaaactacgggttcagattatgcgatcatgcaaacgctgattggcagcgacacaaaacgcatatacgttcgctttgttgtcaatggaagttggacggagtggagtcaggtagttgtttcaggatggaatcaggatgtaaccgtcaggtcgttaacctcgacgactccatcaaaattaggcggcgggcgtgttgatgtgctggggagtacgtcagattacagtagtatgaattgtgctgtgcgcggtgttgatagcactggaaccaattcggcgtggtcagtaggtacatcgaaaaacacgggaaaaatgttgtgccttaaaaaccacagaagcagcgctcaagtgctgttaaatggcgatgatggcgcggtgcaactactaagcggtactgtcaacggtgctacagcacaggcgctaaccatcaacaaagatgaggttaactcaactgccgatttagtaattagaaaacaaacagggactggcaatcgttttgctttacttaattcaggtaattcagaactaccagttggtatcagggtgtggggttccagtactcgtcaaaacgtttttgaggttggaacgtctactgcgtatctgttttatgcgcaaaaaacgtcagcaggccagttgtttgatgtaaatggcgctattaattgcacaacgctgaatcagtcatcagaccgcgaccttaaagacgatattctcgttatcagcgacgcgacgaaagcaatccgtaaaatgaacggatacacctacacgctcagggaaaacgggatgccttatgctggcgttattgcacaggaagtaatggaggcgataccagaagctgtgggatcgtttactcattatggtgaagagttgcaaggtccgaccgttgacggcaacgagctacgcgaagaaacgcgctatcttaatgttgactacgccgccgtgacgggcttacttgttcagttcgcccgtgaaacagatgatcgcgttaccgcgctggaagaggaaaacacaacgctacgtcaaaatctggcaacagcagacacccggatcagcactctggaaaatcaggtaagcgaactggttgcacttgtccggcagttaacaggaagcgaacattga

SEQ ID NO: 85 - DNA, 2373 bp, Artificial sequence
  Synthetic: STF-71
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcatcttctgccactgcatcagccaacagtcaaaaagctgcaaaaaccagtgaaaccaacgcaaaggcgagcgagactgcggcggctaactcggcgaaagcatccgctgcaagccagacggcagctaaagcaagtgaagatgcagccagagagtacgcaagccaggctgcggagccgtataaacaagttttgcagccgcttcccgatgtgtggataccgtttaacgattcactggatatgattacgggcttttcgccgtcatataaaaagattgttattggtgatgatgaaataacgatgtctggcgataaggttgtaaagtttaaacgcgcatcgaaagcaacctatattaataaatctggtgtgctgacagaggctgccattgacgagccacgatttgaacgtgatggcctgcttattgaggggcaaagaacaaactacatgctcaattcggaaagccctgccagttgggggcgatcgtcaaatatggatgtgcccgaaacagggacggataattttggttttacctatggaaagtttgtctgcaacgattctctgattgggcaaacctcagccattaatatggcatcaattgctgcaacaaagtcagttgatgtctcaggcgataataaacacgtgacaacctcatgtcgttttaaaacagaactgcaggtaaggttgcgtatccggtttgataaatatgacggtagcgcaacaacttttcttggtgatgcgtatattgatacacaaacgcttgaaattaatatgacaggcggtgctgcctcaaggattacagcgagagtcagaaaggacgaagctaccggatggatttttgcagaggcaacaattcaggcaattgatggggagttaaaaataggttctcagatacagtattctcctaagcagggcggggcaaccgtatctggtgactatatttatctggccaccccacaagtagaaaatgggccttgtgtatcatcttttattatatcaggaacgacggcggcgacccgcgcaagcgatatagtcacagttcccattaagaataatctttataatcttccttttacggttctttgtgaggtacataagaactggtataaaacgccaaatgcagcgccgcgtgtttttgacaccggcggtcatcaaaccggagcggcaattattcttggattcggttcttcagcagattacgacggatttccttattgcgatattggaggagctaacagacgggtaaacgaaaacgcattgcttgaaaaaatggttatggggatgcgtgtaaagtcagatcagtctacgtgctcagtaagtaacgggcgtatatccagcgaaacaaaaaccacatggtcctatattcagaacaccgcaattatccgtattggaggccaaactacagccgggttacgtcatttatttggtcatgtcaggaatttcagaatatggcacaaggcattgactgatgctcaggtgggggagtcaatctaa

SEQ ID NO: 86 - DNA, 282 bp, Artificial sequence
  Synthetic: STF71-AP1
atgaaagatttaacactcaaattagccgacagggccgacttttcggcctttatggagagtactggctattatgatgacgagtcgatgcaggatgatattcttattgacgtgataggtaacgtgtacaaagaaaccggagaactgaatgaagatggcgaaccggtatgtgttaaggaagacggatattttgtaaacgtgcgcatcattaatgatgtgaaaacaccgtcaatattcgatgaatacgtggttgctgttgagcatcaacttcgtggctggatgtga

SEQ ID NO: 87 - DNA, 3294 bp, Artificial sequence
  Synthetic: STF-20
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgtctggcgaaaaatcagaacggtgcagatatccaggataaatcagcttttctggacaatattggtgttaccagcctgacgtttatgaaaaacaacggcgaaatgccggttgatgctgatctcaatacatttggtccagttaaggcttatgtgggtgtctggtataaatccacatcctccaacgcaacactggagaaaaatttccctgaagacggtgcagtcggtgttcttgaggtattcaatggcggtaatttttccggaatgcagcgttataccaccagaactggcaatgtttatatgcgtaatctttctggcacctggaatggctcagacggtccgtggatctactggcgtcagattcagtctgcaacacgccccctgagcacaactattgacctgaacacgctaggaggcgcagagcatcttggtttatggcgaaacagtagtggctctatcgcttcatttgaccgcaactatccggaagaaggaagttatggtcagggattccttgaagttcttgagggtggtgggtactcacgcacgcaacgctatacgacccgccgtgggaacgtatatgttcgctgcctttctgctatatggaatgcacagaacccacagtgggagccgtggtcaagagtaggccatcagtcagaatgtcgttattacgaaggtgatttgaatgatctgacttcgccaggcatttacagcgttacagggaaggcgtcaaacggtccaatgcaggataccgctggagcgacactgcttggaatactggaagtaatcaggcgttttgatggtgtatctgtctggcagcgttacacaaccacagggaaatcagaaaccacacaggggcgcacttttgagcgcgtctatgccgggagcaaatggaccgaatggcgagaagtatataactccttttcgttgcctctgaatctgggcatcggtggcgcagtggcaaaactatccagtctggactggcagacctacgattttgtgccgggcagtctgataaccgttcggcttgataatatgaccaacattcccgacggtatggactggggcgtcattgatggcaacctgataaacatctcagtcggtccgagtgatgattctggttcggggcgctcaatgcatgtatggcgcagcactgtaagtaaagccaactaccgcttttttatggtgcgcatttcaggaaatccgggaagccgcacgatcacaacaagacgagtaccaatcattgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactattggtggggcatcaacgttaattcttcattttaatatcggggaaggaagttgtcccgccgcccagtttcgcgttaattataagaacggtggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtg

SEQ ID NO: 88 - DNA, 525 bp, Artificial sequence
  Synthetic: STF20-AP1
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgatgagaataatataattgtcggcatcaccagagatgcttcaacgctcaaccctgaaggttttagcgttgtcgaggttcctgatattaccgccaaccgacgtgctgatgactcaggtaaatggatgtttaaggatggtgccgtgattaagcggatttatacggcagacgaacagctgcaactggcggaattacagaagtcagctttgctttccgaagctgaaactatcattcagccactggaacgctctgtcagactgaatatggcaacagatgatgagcgtagccgactggaagcatgggaacgctacagtgttctggtcagccgtgtggatcctgcaaatcctgaatggccggaaatgccgcaa

SEQ ID NO: 89 - DNA, 2274 bp, Artificial sequence
  Synthetic: STF-23
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaagccccattaaacagcccggcgctgaccggaacgccaacaacaccaactgcgcgacagggaacgaataatacccaaatcgcaagcacggctttcgttatggctgcgattgccgcccttgtagattcgtcacctgatgcactgaacacgctgaacgagctggctgcggcgttgggcaacgacccgaattttgcgaccaccatgactaacgcgcttgcgggtaagcaaccgaaagatgccaccctgacggcgctggccgggcttgctactgcggcagacaggtttccgtattttacggggaatgatgtcgccagcctggcaaccctgacaaaagtcgggcgggatattcttgcgaaatcgaccgttgctgccgttatcgaatacctcggtttacgagaactcggcacaagcggggagaaaataccgttactcagtacagcgaatacctggaccaatcgacaaacattcagcggtggcctttctgggggactgtccggcaatgccgctactgcaacaaagctgaaaacagcacgaaaaattgctggagttggttttgatggttctagcgatatttcaattagtgccaaaaatgtcaatgcatttgcactccgacaaacaggtaatactgttaatggtgatacatccgttggatggaattgggatagtggtgcatataacgccctgattggtggtgcatctgcattaattcttcactttaatataaatgctggtagctgtcctgccgtacaattccgtgtgaattataaaaatggtggcatttcctacaggtcggctcgtgatggttatgggtttgaattaggttggtcagatttctataccacgacacgaaaaccttcagcgggagatgttggtgcatatacgcgggcagaatgtaactcaaggtttattacaggtattcgccttggcggtctgtcatctgttcagacatggaatggtcccggctggtctgacaggtcaggttatgtcgttacgggttcagttaacggaaaccgtgatgaattaattgatacaacacaggcaaggccaattcagtattgcattaatgggacgtggtataacgcggggagtatttaa

SEQ ID NO: 90 - DNA, 531 bp, Artificial sequence
  Synthetic: STF23-AP1
atgatgcacttaaaaaacattactgctggcaaccctaaaacaaaagagcaataccagctaacaaagcaatttaacatcaaatggctttattcagatgatggaaaaaactggtatgaggaacaaaagaatttccagccagacactttgaaaatggtctatgaccataacggcgttattatttgtattgaaaaggatgtttcagcaattaatccggaaggcgcaagcgtcgttgaattacctgatattacagcaaatcgccgggctgatatttcggggaaatggttgttcaaagatggcgtagtgataaagcgaacttataccgaggaagagcagaggcaacaagcggaaaatgaaaagcaaagcctgttgcaacttgtcagggataaaacccagctatgggactcacagctacggctgggcatcatttccgacgagaataaacaaaaattaaccgagtggatgctctatgcgcagaaagtcgaatctacagacacctccagcctgccagtaacgtttcccgaacaaccagaa

SEQ ID NO: 91 - DNA, 2136 bp, Artificial sequence
  Synthetic: STF-24
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgtcttcagaaagatcagaacggtgcggatattcctgataaaagattattcctgcgcaatattggagcaacaaattcaacaaccatgtcttttagtggtggtacaggatggttcaggctggcaactgtaaccatgccccaggccagttccgtggtttacataagcctgattggtggtgccggatataatgttaactcccctatgcaggctggtatatctgaacttgttcttcgtgcgggaaatggaaatccaaaaggtcttactggtgcgttatggcgacggacatcggttggatttactaattttgcatgggtgaatacatccggtgatacctatgatgtttatgttgaaataggtaattacgccacaggtgttaatattcagtgggattataccagtaacgccagcgtaacgattcatacatcaccaacttatacagcgaataaaccaacaggcctgacagatggaactgtatatgtaatttacagttcgtacattaaaccgactgctgctgatgttggggcgttatcattatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtg

SEQ ID NO: 92 - DNA, 528 bp, Artificial sequence
  Synthetic: STF24-AP1
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgatgagaataatataattgtcggcatcaccagagatgcttcaacgctcaaccctgaaggttttagcgttgtcgaggttcctgatattaccgccaaccgacgtgctgatgactcaggtaaatggatgtttaaggatggtgccgtgattaagcggatttatacggcagacgaacagctgcaactggcggaattacagaagtcagctttgctttccgaagctgaaactatcattcagccactggaacgctctgtcagactgaatatggcaacagatgaggagcgtagccgactggaagcatgggaacgctacagtgttctggtcagccgtgtggatcctgcaaatcctgaatggccggaaatgccgcaataa

SEQ ID NO: 93 - DNA, 2523 bp, Artificial sequence
  Synthetic: O111-2.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggctcctctgaactctccggccctgactggcacgcctactactccgactgcgccgcaagggaccaactctacccagattgcgtccacggcattcgttatggctgctattgcagcactggtagattcctcgccggacgctctgaacactctgtcggaactggcggctgcactcggaaatgatccgaacttcgccaccaccatgactaacgctctggccggcaaacagccgaaagatgctaccctgaccgccctggcaggtctcgtgaccgctgcggaccgcttcccgtatttcacaggcaatgacgttgcctccctggctaccctgaccgaggttggtcgtgacatcctggcgaagtctaccgttgcggccgtgattgaatatctgggtctgcaggaaactgttaaccaggcatcaggtgcattacagaagaatcaaaacggtgcagacattccgggcaaagatacctttaccaagaatatcggtgcttgtcgtgcttattcggcatggcttaatatcggaggtgattctcaggtatggactacggctcagtttatctcttggctcgagagtcagggtgcgtttaatcatccgtactggatgtgcaaaggctcttgggcgtacgcgaacaacaaagtcatcaccgacactggttgtggtaacatctgtctggcgggtgcagtagtggaagttatcggtacgcgcggtgcgatgacgatccgtgtaactactccatctacctcctccggtggcggtatcaccaacgcccagttcacttacattaaccacggcgatgcctatgctccgggctggcgccgtgattacaacactaaaaaccaacaacctgcgtttgcactgggtcagacgggtagtcgtgtggcgaacgataaagcggtcggttggaattggaactctggtgtgtacaacgctgatattagtggagcttctactctgatccttcattttaacatgaatgctggaagttgtccggcagtgcagtttcgtgttaactatcgtaatggaggaatcttttaccgctctgcacgtgacggctacggcttcgaagcgaactggagtgaattttacacgaccactcgtaagccgagtgctggagatgtgggagcttatactcaggcagaatgcaattcgcgtttcattactggtattcgtctgggaggtttaagttccgtgcagacttggaacggtccaggttggagtgatcgtagtggctatgttgtgacaggcagtgttaacggcaaccgtgacgaactgatcgacactactcaagcgcgtccgatccagtactgcattaacggaacttggtataacgcgggaagtatctaa

SEQ ID NO: 94 - DNA, 534 bp, Artificial sequence
  Synthetic: O111 2.0-AP1
atgatgcacttaaaaaacattactgctggcaaccctaaaacaaaagagcaataccagctaacgaaacaatttaacatcaaatggctttattcagaggatggaaaaaactggtatgaggaacaaaagaatttccagccagacactttgaaaatggtttatgaccataacggcgttattatttgtattgaaaaggatgtttcagcaattaatccggaaggcgcaagcgtcgttgaattacctgatattacagcaaatcgccgtgctgacatttcgggtaaatggatgttcaaagatggcgtagtggtaaagcgtacttacacagaagaagagcaacgtcaacaggcggaaaatgaaaagcaaagcctgctacagctcgtcagggataaaacccagctatgggacagtcagctacggctgggcatcatttccgacgagaataaacaaaaattaacagagtggatgctctttgcgcagaaagtcgaatctacagacacttccagcctgccagtaacgtttcccgaacaaccagaatga

SEQ ID NO: 95 - DNA, 2265 bp, Artificial sequence
  Synthetic: STF-74
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatatacggctcaggacgcgagcacggcgcagaaaggtctggtgaaactgagcagcgccaccgacagcacatctgagaccctcgccgcgacaccgaaagcggttaaggcggtgaatgataatgcgaatggtcgcgtcccgtctgagcgaaaagttaacggacattcgctggccggtgatatcagtgtcacctcacaggatatttttgacggtcagtgtgttgaaattggtccgggtcaggatctggataattaccagacgccgggtctgtattttcagcccgcaaatgccaataccagtgctgctctgcattacccggaaaataatgccggttccctgatggttttaagaagcgcagggataacgcaggtttatcgcgtgtacagcggttcgcgaagttatttgcggagcaaatattccacgcagccatggacgacgtggacacccgatgatgcttttcctgtcggcgcgccgattccgtggccatctgacatcgccccgcccgcttacgccttaatgcaggggcagtcatttgataaatctgcatatccattgcttgctgtagcgtatccctctggtgttatcccggatatgcgtggtcagacgataaagggcaagccggacggacgagcggtactctcgtatgaacaggacggtattaaatcgcacgctcatacagccagtatttccgataccgatttgggaacgaaatataccaactcttttgattatggttcaaaaccaacaaccagttttgactacggcaataagtcctccactgaggggggatggcacgtacataactttcgttattgtgctacgtctgcataccgggatactcctggctcagggctggggatgcactcgtcgaatatttcgtggtcagccggggatcgcattgaggggagtggtaatcatgcacatgttacgtggattggtccccatgatcactgggttggtatcggtgagcataaccattatgtggttatggggtatcacggacatacagcgaccgttcatgcaaccgggaatacagaaaacaccgttaaaaatattgcgtttaactacattgtgaggcttgcataa

SEQ ID NO: 96 - DNA, 579 bp, Artificial sequence
  Synthetic: STF74-AP1
atggcttttgaaatgaccggagaaaaccggacaattattctttataaccttcgttcagatacaaatgaatttattgggaaatctgatgggtttatccctgctaatacgggcttgcctgcttacagtaccgatatcgcgcccccaaaagtgacggcaggttttgtggctgttttcgatgcacagacgaataaatggtcgcgggtggaggactaccgcgggacaaccgtctatgacatcagcaccggtaagcccgctgttattgaaaaacttggcgctctgcctgataacgttgtgtcggttgctcctgacggggagtatgtaaaatgggatggcgctaagtggatccacgatgccgaagcggaaaaaacatttcgtcaggggcaggcggcgcaggaaaaatcaaacctgctgatgattgcaacatcggctattgcccccctgcaggatgccgttgatctggatatggcaacggaagacgaagcgaccgcgcttaatgaatggaaaaaataccgggtcatgctcaacagagtcaaacccgaagatgcccccgatatcacatggccggaactgcccgcataa

SEQ ID NO: 97 - DNA, 2133 bp, Artificial sequence
  Synthetic: STF-86
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgcgttccggcatcacgaaaagtgaacggccatgccctgaatggagatatcaatgtcacttcacgggatatttttgacggccaggttatagcgattggtgcaaataagaatctggatgattaccaggtaccggggctttattttcaggaagcgaacaacaataccagtgcagcaatgaattacccggagaatagcgcgggttctctgatggtactgagaggtgccggagtcactcaggtttatcgtgtgtacaacagctcgcgcagttattcgcgcagcaagtattcaacgctggcatggacgccgtggatgccagaagattcttaccctgtcggcgcacctatcccctggccatcggatgttaccccgacagggtacgccttaatgcaggggcagccctttgataaagcggtctatccattgctagcgattgcctatcctgcggggattatcccggacatgcgaggccagacgattaagggtaaaccgaacggtcgcgcggtactctcgtatgaacaggatggtgttatatcgcatacccacggagccagtatttccgataccgatttggggacgaaatacaccagctcttttgattatggttcaaaaccaacaaccagttttgactacggcaataaatcctccactgagggtgggtggcacgcacataactttcgttattgcgcaacgtctgcataccgggatacccccggtcaggggctggggatgcattcgtctaatgtttcatgggcggcgggagatcgcattgagggaagcggtaatcatgctcatgtgacatggatcggccctcatgatcactgggtgggtattggtgcgcataaccattatgtggttatgggctatcacggacatacagcgaccgttcatgccgcaggaaatgcggaaaataccgttaaaaatattgcgtttaactacattgtgaggcttgcctga

SEQ ID NO: 98 - DNA, 588 bp, Artificial sequence
  Synthetic: STF86-AP1
atgacttttgaaatgaccggagaaaaccggacaattaccatctataacctgcgtgctgatacaaatgaatttatcgggaaaagtgatgggtttatccctgctaataccggtttgcctgctaacagtaccaatattgcgccaccgccgatgaaagccggttttgtcgctgtatttaattctgcgtcagaaaaatggtcacttgttgaagaccatcgcgggaaaattgtttacgacattctcaccgggaaatccatcacgattgatgaattaggtcagttacctgacgacgttgtttccgttgcgccggaaggccattttgttaaatggaatggtaaaaaatgggtgcatgatgctgacgcagaaaaaacggcacagattacacaggctacacagcaaaaagacagtcttctggcgctggctgcatcaaaaattgccccattacaggatgctgttgatctggatattgcaacggaagaggaaacagcgcttttgctggcgtggaaaaaatacagggttttgattaatcgtattaagccagaagatgcgccagatattgactggccggaggttccgggcgatgtggcgtga

SEQ ID NO: 99 - DNA, 2592 bp, Artificial sequence
  Synthetic: STF-84
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatacaccgcacaggatgcaacgacagcacagaaagggatagttcagcttagcaacgcgaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcgcatctgaaacgcttgccgcgacaccgaaagcagctaatgataatgcgaatggtcgggtaccttctgcccgtaaggtgaatggtaaggcgctttcagcggatataacactgacgccgaaagatattggtacgcttaactcaacaacaatgtcattcagcggtggtgctggttggttcaaattagcaacggtaaccatgccacaggcgagttctgttgtttcaattacgttgattggtggcgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagggcagttttatccgcctggcgcaccaatcccgtggccatcagataccgttccgtctggttatgccctgatgcaggggcagacttttgacaaatctgcttacccgaaactcgcagccgcttatccgtcaggcgtgatccctgatatgcgtggctggacgattaagggcaaacctgccagtggtcgtgccgtattgtctcaggaacaggacggcattaaatcgcacacccacagcgccagcgcatccagtacggatttggggacgaaaaccacatcgtcgtttgattacggcactaaatccacgaataacaccggggcgcatacgcacagtgtgagcggtacagccgcaagtgccggaaaccatactcatagtgtcacaggcgcatcagcagtcagccagtggtcacaaaatgggtcagtacataaggtagtgtctgcggccagtgtgaatacaagtgctgcaggagcgcacactcatagtgtcagcggcacagccgcatctgcaggtgctcacgcacatactgtcggtattggtgctcatacgcactctgttgcgattggctcacatggacacaccatcaccgttaacgctgctggtaacgcggaaaacaccgtcaaaaacatcgcatttaactacattgtgaggcttgcataa

SEQ ID NO: 100 - DNA, 585 bp, Artificial sequence
  Synthetic: STF84-AP1
atggcattcagaatgagtgaacaaccacggaccataaaaatttataatctgctggccggaactaatgaatttattggtgaaggtgacgcatatattccgcctcatacaggtctgccagcaaacagtacctatattgcaccgccagatattcctgctggctttgtggccgttttcaacagtgatgagggatcgtggcatctcgttgaagaccatcggggaaaaaccgtctatgacgtggcttccggcgacgcgttatttatttctgaacttggcccattaccggaaaatgtcacctggttatccccggaaggggagtttcagaagtggaacggcacagcctgggtgaaagatgcagaagcagaaaaactgttccggatccgggaggcggaagaaacaaaaaacagcctgatgcaggtagccagtgagcatattgcgccacttcaggatgctgtagatctggaaatcgcaacggaggaagaaacctcattgctggaagcctggaaaaagtatcgggtgttgctgaaccgtgttgatacatcaactgcacctgatattgagtggcctacgaaccctgtcagggagtaa

SEQ ID NO: 101 - DNA, 3849 bp, Artificial sequence
  Synthetic: STF-93
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtagggtgccatctaaccgaaaagttaacggtaaagcactgactgcggatatcacattaacgccgaaagatattggtactttaaattcagtaacgatgtctttctctggcggggctgggtggttcaaactggctacggttaccatgccacaagcgagttccatcgtttacatcgcattgattggtggcgctggttacaacgtcggctccccacatcaggcaggcatttcagaactggttctacgagcaggcaatggaaaccccaaagggattaccggtgctttgtggaagcgtacagccgtcggattaacgaatttcgcctggatcaacacatccggcgatacatatgatatttacgttgagattggcaattatgcgactagtgtaaatatccattgggattgtactgcaaatgcgacagtttctatttatacatcgccaacatattcagcgagtaagccttccagcgttaccgatggtgttgtttatacgatgtatagcacacatcagaaaccgacgccgttagatattggagcactgccaacaaccggaggaacagtttcaggtccgttgtctgttactggtgggatcaccggaacattaaatggtaatgcaagtacagcaacgaaattgcagacggcaagatctatcggtggagttggtttcgacggttctgcaaatatcaaccttccaggtgtaaatactacgggtaatcagaacaccactggtaatgctgcaactgctacaaaacttcagacggcaagaactatcggcggcgtgagctttgatggtactgcgaatattaatttgccaggtgttaatacgactggtaatcagaatacaacgggcaacgcggctactgctacgaagttgcagactgcgcgtactatcaatggggtgtcgtttgacggctcggcaaatatttccttgtcgccagcaaatataggttgcccggcatctcctactggttggttaactacaggaagtaatggcggagcaataacaacagcacagttagtgacgttattgcaaaataatggagcatttaacacaaagtcatggattgctcgatgtgcgtgggcctatgccaatagtgcaaccataccaaatagtgaaactggttgtggcgttattccattggcaggagctgttatagaggtatttaataacggtagtagctcaaacaattatacgatccgtataacaacggccacaacgacgagtgtctctggtgctctcactaatgcggagtttatctatgtatttaatggcacagattattctccgggatggcgaagagtatataacacgaaaaacaaaccaacagcctctgatgtcggtgcattacctcttaccggtggtacattatctggaggtttgacatcttctggcgagatcatttcaaaatatgcaaatggtttccgcattgcttacggtagctttgggttctttatccgtaatgatggatcgaacacatatttcatgctaacagcatcaggagacacattaggttcatggaacggtttgcgacctattacaattaataataccagcggtgcggtatcaattggtaatggactaaatgtgactggtggcgtaaatggtagtttgaacggtaatgcttcaacagctacgaagttgcaaacagcgagaaacatcaatggtgttaagtttgatggctcaggcgatatcaacattaatacactggtatctcgtggccgagttacggcattaagcggctctactcaaggcactgctggcattcaaatgtacgaggcgtacaacaatagctacccgaccacgtatggcaacgtattgcacatgaaaggtgcgagtgctgctggtgagggcgagttgcttattggctggagtggtacgagcggtgcacatgcgccagttttcattcgctcacgaagagataccacagatgcggcatggtcagcgtgggcgcagctatatactgctaaggattcaatccctggtgtgaatacaaccggtaatcagaatactactggtaatgccgcaacagccacaaaattgcagacagcaaggaaaattgctggtgtggcgtttgatggctctgccgatattactttgactgcggctaaccttaatgcttatacgaaaacagaggtaacaaaccttctaagttcctatgcaagcagatcatcactgacaggctatagtggcaacctggatattattgctgaaacactggttgtcaaatcaggcggtagtggagggtttgctatatgggatattggcacaactactagcggtgccaatatgtacattgatccaaaccctggtatcaatacagtttggcgttcaacatcttcaaggcgctataaaaaggatattgaaacattacaagatcgatatgctgatgaacttttgtcattaagacctgtttggtatcgttcaatttgtcgaggtgaccgaaaggattgggggtattacggccttattgctgaagaggttggtgagattgccccgcaatatgtccattggcgtgaaccaacaaataatgattctccagaagatatttcctcaaatggtatggtcgctgaaggggtgatgtatgagcgtttggttgtaccactcattcatcatattcagcaattgaccaaaagggttgaggagcttgaaacgaagttaaattcacctaaagaa

SEQ ID NO: 102 - DNA, 2397 bp, Artificial sequence
  Synthetic: STF-95
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgggtaccttctgcccgtaaggtgaatggtaaggcgctttcagcggatataacactgacgccgaaagatattggtacgcttaactcaacaacaatgtcattcagcggtggtgctggttggttcaaattagcaacggtaaccatgccacaggcgagttctgttgtttcaattacgttgattggtggtgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagagcagttttatccgcctggcgcaccaatcccgtggccatcagataccgttccgtctggctatgccctgatgcaggggcagacttttgacaaatctgcatacccgaaacttgcagccgcttatccgtcaggcgtgatccctgatatgcgtggctggacgattaagggcaaacccgccagtggtcgtgccgtattgtctcaggaacaggacggcattaaatcgcacacccacagcgccagcgcatccagtacggatttggggacgaaaaacacatcgtcgtttgattacggaaccaaatccacgaataacaccggggcgcatacgcacagtctgagtggctctacggggtctgccggtgatcatactcatggtaatggtattcgttggccaggaggcggcggttctgcgttagcattttatgatggcggtgggttcacttatgtccaggattcacagtatcaagtaagcccggggacttcttcccgtagatcgtattatcaacgtattcagacacagtcagcaggtgctcatacccactcgctgtctggtactgcagcaagttctggcgcacatgcacatactgtaggtattggtgcgcatacgcactccgttgcgattggttcacatggacacaccatcaccgttaacgctgctggtaacgcggaaaacaccgtcaaaaacatcgcatttaactatattgtgaggcttgcataa

SEQ ID NO: 103 - DNA, 585 bp, Artificial sequence
  Synthetic: STF95-AP1
atggcattcagaatgagtgaacaagcacggaccataaaaatttataatctgctggccggaactaatgaatttattggtgaaggtgacgcatatattccgcctcatacaggtctgccagcaaacagtaccgatattgcaccaccagatattcctgctggctttgtggctgttttcaacagtgatgaggcatcgtggcatctcgttgaagaccatcggggtaaaacggtttatgacgtagcgtcaggggacgagttatttatttctgaactcggtccgttaccggaaaatgttacctggttatcgccggaaggggagtttcagaagtggaacggcacagcctgggtgaaggatacggaagcagaaaaaatgttccggatccgggaggcggaagaaacaaaaaacaacctgatgcaggtagccagtgagcatattgcgccgcttcaggatgctgcagatctggaaattgcaacggaggaagaaacctcattgctggaagcctggaaaaagtatcgggtgttgctgaaccgtgttgatacatcaactgcacctgatattgagtggcctacgaaccctgtcagggagtaa

SEQ ID NO: 104 - DNA, 1878 bp, Artificial sequence
  Synthetic: STF-132
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgccgttcagcgtgatggtgacaccatgaccggggaactgaaaatccgtggtgttaatgcgctgaggattttcaacgacgcctttggtctgatttttcgtcgttcagaagagtgcctgcaccttatccctaccagtgaaggtcagggcgagaatggcgatattggtccacttcgcccgttcactattaatctgcggacgggtgaaatatccatgtcgcataaagtgtctgttggcggcggttctcaggtcaatggtgcgctgggtatcggcgttcagaacgcgctgggcggaaactcaattgctttcggggataacgatacaggtataaaacaaaacggcgacggcattctggatgtttatgcgaatggacagcacgtattccgttttcagaatggcgcgttacaaagtcaccgggcagtgaatgtttcagggcgggtaacaccaactgattatggcaatttcgatgaacgctaccagaccaaaacaggcggcgtgcagaattttcagtacaccagtgaggtgtttcacaagccagccggtaatgaggtttcctgggtttttcgggcgccgtcaggttgcactctttctgggattaatgtgcaggagaccggtagtaactctgcggataatatcggtggtgtgtattacaaacaggcccagatttatataaatggcgcatggcgctcagtatcaggttaa

SEQ ID NO: 105 - DNA, 567 bp, Artificial sequence
  Synthetic: STF132-AP1
atggcgctcagtatcaggttaattaaggcaaaaataatggaactcagaaatgtcacgcgttattacccggaaaacatgccttatggtgaaggtgttcagtatttccgtagtgaagacgggcaggatttttatgaatcactggataaattcgcgaagaaatacaagctgtgcacgcatcctgaaaccggtgttatttattcaatggcggaagacgtatcccggctttatccggcaggtttcaccattgtggaagtggatgaactaccggatggcttttgtatagaggcgcgctggtattataaagacggtgaagtactgccggttcctgttgattacagactgctggctgagtcggaacgagcacgtcttacggcgattgctgaacgggaaatatccgacaagaaaacagatttacttctgggaataattaataatggggaaaaagaaatgctgaaattatggcggatgtacatcagaaatttaaagaatattgattttaatcacattcatgataaatcgtcatttgatagtattaaatggccttgtgatcctgagaattcacattaa

SEQ ID NO: 106 - DNA, 4023 bp, Artificial sequence
  Synthetic: K1F
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggtgcgaagggcgatggcgttaccgacgacactgcagcgctgacttccgccctgaacgatactccggtgggtcagaaaatcaacggtaacggtaaaacttataaagttacgtccctgccggacatctcccgctttatcaacacccgtttcgtgtatgaacgtatcccaggccagccgctgtactacgcatcggaagagttcgttcagggtgagctttttaaaatcaccgacactccgtattataacgcctggccacaggataaggctttcgtgtacgaaaacgttatctatgctccgtacatgggttccgaccgtcacggtgtcagccgactgcacgtaagctgggtgaaatcgggcgacgatggtcagacctggagcacgcctgagtggctgaccgaccttcatccggactatccgaccgttaactatcactgcatgagcatgggcgtctgtcgcaaccgtctgttcgcaatgatcgaaacccgtacgctggcaaaaaacgctctgactaactgcgccctgtgggatcgtccaatgagccgctctctgcacctgacgggtggtattaccaaagcagcgaaccagcgttacgccaccattcacgtaccggatcatggtctgttcgttggtgactttgtaaatttctctaattctgcagttaccggtgtgtctggcgacatgaccgttgcgaccgtaatcgataaggacaatttcaccgtcctgaccccgaaccagcaaacctctgatcttaacaacgctggcaagaactggcacatgggcactagctttcacaaatctccgtggcgtaaaaccgatctgggcctgatcccgtctgtaactgaagtgcactccttcgcgaccattgataacaacggtttcgctatgggttatcaccaaggtgatgttgcaccgcgtgaagtcggcctcttttattttccggacgcattcaacagcccgtccaactacgtgcgccgtcagattccgtctgaatatgaaccggacgcctccgagccgtgcattaagtactatgacggtgtgctgtacctgattacccgtggcacccgtggtgatcgtctgggttcatctctgcatcgctcccgcgacattggtcagacgtgggaaagtctgcgcttcccgcacaatgttcatcacaccaccctgccgttcgcgaaagtcggcgatgacctgatcatgtttggctccgaacgtgctgaaaacgaatgggaagcgggcgccccagacgatcgctacaaggcatcttacccgcgcaccttctacgcgcgtctgaacgtgaacaactggaacgcagacgatatcgaatgggtaaacatcaccgaccagatctaccagggtggtatcgtgaactctggtgtgggcgttggttccgttgtagttaaagataactacatctattatatgttcggcggcgaagaccacttcaacccgtggacttacggcgataactccgcgaaagacccgttcaaatccgatggtcacccttctgacctctattgttacaaaatgaaaatcggtccggacaaccgtgtttcccgcgattttcgctacggcgctgttccaaaccgtgcagttccggtattcttcgacacgaacggcgtgcgtaccgttccggctccgatggaattcaccggcgacctgggtctgggccacgtaaccattcgtgcctccaccagctctaacatccgttccgaagtactcatggaaggtgaatacggctttatcggtaagtctatcccgacggacaacccggcaggtcagcgtatcatcttctgcggcggtgagggtacctctagcaccaccggcgcgcaaatcaccctgtacggcgctaacaacaccgactctcgtcgtatcgtatacaacggtgatgaacatctgttccagtccgcagacgtgaaaccgtacaacgacaacgtcaccgcactgggtggtccatccaaccgtttcaccactgcgtacctgggttccaacccgatcgttactagcaatggtgaacgcaaaactgaaccggtagtgtttgacgacgcttttctggacgcatggggcgatgttcattacatcatgtatcagtggctggatgccgtgcagctgaaaggtaacgacgcgcgtatccactttggtgtgatcgcacagcagattcgcgatgtcttcatcgcacacggtctgatggatgaaaatagtactaactgtcgctatgcggtgctgtgctatgacaaatacccgcgtatgaccgacaccgtgttctcgcacaatgagattgttgaacataccgatgaagaaggtaacgtgactactaccgaagaaccggtttataccgaagtggttattcacgaagaaggtgaagaatggggcgtgcgtcctgatggtatctttttcgcggaggcagcgtaccagcgtcgcaaactggaacgcatcgaagctcgtctgtcggcactggaacagaaa

SEQ ID NO: 107 - DNA, 3462 bp, Artificial sequence
  Synthetic: K5
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcctaaaaccgaaggtatcctccataaaggtcagagcttatacgaatatctggatgcccgtgttcttacttctaagccattcggtgcagcgggtgatgcaacgaccgacgacacggaggttatcgctgcgagcctgaacagccagaaagctgttaccatctctgacggcgttttcagttcttctggcatcaactccaactactgtaacctggatggtcgcggatccggtgtgctcagccaccgtagctctactggtaattacctggtgtttaacaatccgcgtactggtcgtctgagcaatatcactgttgaatctaacaaagcgaccgataccactcagggccaacaggtgtccctggcaggtggcagtgacgtgaccgtgtcagatgtcaacttctccaacgtgaaaggcactggttttagcctgattgcctacccaaacgatgctccgccggatggcctgatgatcaaaggcattcgcggatcttacagcggttacgcgaccaacaaagcagctggttgcgtcctggcggatagctccgttaacagcctgatcgacaatgtgatcgctaagaattacccgcaattcggtgctgttgaattaaagggcactgcaagctacaacattgtatcgaacgttatcggtgcggattgtcagcacgtgacttacaacggcactgagggaccgatcgctcctagtaacaatctgatcaagggcgttatggcgaacaacccgaaatacgcggcagttgtggcgggtaaaggctcgacgaatctgatctctgatgtactggtagactattctaccagcgatgctcgtcaggcgcatggtgttaccgtcgaaggatctgataacgtgattaacaacgtactgatgtccggttgcgacggaactaattccctgggtcagcgtcaaaccgcaactatcgcgcgtttcatcggtactgcaaataacaactatgctagcgtgttcccatcctattctgccactggtgtgatcacgtttgagtctggcagtacccgtaacttcgtcgaggttaagcatccgggccgtcgcaacgatcttctgtcatcggcaagcacgattgacggcgctgcgaccatcgacgggacttctaactctaacgtagtacacgcgcctgctctgggccaatacattggctccatgagtggtcgctttgaatggcgtattaagtcaatgagcctgccgtccggcgtactcactagcgcggataaataccgtatgctgggtgacggtgctgttagccttgctgttggcggaggaactagcagtcaggtgcgcttgttcacctcagacggtacttctcgcactgtttctctgaccaatggtaacgtgcgcctgagcacgtcctctactggctatttacagctgggtgcagacgcaatgactccggactccactggtacttacgcgttaggctccgcatctcgtgcttggagtggcggattcactcaggcagcattcaccgttacttctgacgcacgttgcaaaactgagcctttaaccatctctgacgctttactggatgcttggagtgaagtggactttgtccagttccagtatctggatcgtgttgaagagaaaggtgctgactccgcgcgttggcatttcggaatcatcgcccagcgtgctaaagaggcattcgaacgtcacggcatcgatgcgcatcgttacggtttcttatgctttgactcttgggacgatgtgtacgaagaggatgcaaatggatctcgcaaactgatcactccggcgggtagtcgctatggtattcgctatgaggaagttctgatcctcgaagcagcgctgatgcgtcgcacgatcaagcgcatgcaggaagcactggctgcgttaccgaag

SEQ ID NO: 108 - DNA, 3225 bp, Artificial sequence
  Synthetic: STF-37
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggagttatctggagagcacgggtcgtttttgattggcggagtaattgattgttactcaaccgtttcagatcttatttcttcctccccatccgttggtagagtatgcaggactatagggtattacagcccaggtgatggaggtggggcagattacataattagtattggaactccgatgcaagattttagcgattctggttctatagttatagatgaatgcaagttcgctaaattaatccagcaaagccaatatgatttaaagcagtttggagtaaaaccatctgacccgtcttatgcagaaaaaaacgacatatttatctcgcaagccattactaggtctagagttggaagatgcaagattattataagcgatgttatatatcataaaaaacctttaatttttgattattacaatcatatggaaggaagttgtattggtagtgacccggaatttactcctaggtttataaaaatagataatacaactagcggtttgccagatatgggataccctggtgttgctgatgttgtatcttacgatgttgatgcaggaataataattaaaagacagaattctggcacaagttttgccagaggtttcataattaaggggtttcttcttcagtcggagaagaaatcagcatgggcaatttacgcgccgcatatggcggattttgatatagacattgatagtcgtgggtttaatggaggaatcagatggtttgttaattttcttggaagaatggcaggaagacatataggtcttggtgcaaactcatcagatccaacattatctataggtgcgtggtgttcgaaattctctacaatacctgattgtggtaattccgttgtattcagattgtcattcaatggatttaacagaggtatgcaaatggagtattttggtaatggggttttagatagagtaactcttgaaaatatttcaaaaccaacacctacgtcgccaacaacacatggaatatatgcaactgatacatggttaactggccaggtgtcatgtgaaagttcttcaacctgcatcatccgtgctggcaataacgcgaacttcgatattacccttagtgcggtattccatgttacgcaagatgatccttccgagggtattgttcatgtattaaatggaggccgcctaactctgcgttcatctacaattcttgctgatttggcagatacaaaaatcattaatgagaatggaggttatctcgatattgccgcaaataccagaacaggaaatattgtttattccaatagtgataattacagattcaaagacagaaccattggttttggtcagactgcggcaactacaaaaacaagcttctcttctggtgaagagattacattttcactactaaacggaacgccaaaagcgaatctatctggcggaacgatccagtttaactctccatgcctgattaaaatcactgtgcaggggaggggtataacatcaggagcacttacttttgggataaatggagaatcttcagagagcgtgagtcagggacagcaggtttctatggttgtcggagtggtatccggtgacattcttaacctgaaggcaacctcatcactgacgctgggtagtgcaggaggggtgcgggtacttcttgagcctgtaaac

SEQ ID NO: 109 - DNA, 2865 bp, Artificial sequence
  Synthetic: 1JL
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggctacaaagttcagagcttagcaattctgtccgacacccaagctgtccacgatgctactaacaccattaaaacccagacggacaagatcaaggcagacacgcaggcaatcaaaactcaaacaaatcaaattaaaaccgaaacgggcgtaattcgtgataaagcgaacactgcgaaaactgatgcgcaggccgcgagcgccgccgcacaaggcttccgtgatcaggcgaaggagtgggcacaaagtgtaaacgctgataacttattaaccaaaacgggcaacttagctggcctgactgacaagagcgcggcacgttctaatttagggctaggaagcgtagcaacggaaaacaccgttccaattaagaaaggcggcactgcggcaacgaccgtcgcggcggcacgctccaatttagggctgggtagcgttgcaacggagaacactgtcccaattgaaaagggggggactgcggcgacaaccgccgcgaaagcgcgtagcaatctgggtttaggtagcgtagctacggagaataccgtgccgattgaaaagggcggcacggcggcgaccactgccgctaaagcccgttcgaacttcggcttaggcgataacaacaaagtaaaacttggtacactgcgcctgaacgggggtgaatctctggttttcaacgatgtggaacgcaatggcctgattatcagcaacgccagcttcggtatcgatagctgggttggtcaaaccatgcacaaatggtataccgattggacgcgtgctggcttagtgcgtgcaggtgacgcgcatctgagcgattatcgtgtgcatgtttggaaagacggtttcaccgaagccctgtttcgtttcctgccggacgggcgcttgatttccggcaactccggtaatccgtctgttaacgaatttcaaaaagccccgctgtctgatcgtgacctgaaaaaagaaatcaagtacactgatggcgaagaatcctataaccgtgttcgccaatggcttccggctatgttcaaatacaaagagagcgacgttcagcgttacggcctgattgcacaagatctggcacgtattgatccggaatacgttcacttattaccgggctatgcaatctacgaagacgttaagggtgtagacgaagagggcaatgaggttgttgtggatcgtaaagagatcggctataccgacgatgtgttatctctggattctaacgtcttattaatggatttatgcgcggcattcgtgcatttattacataaagttgaaaaattggaaggcaaa

SEQ ID NO: 110 - DNA, 3153 bp, Artificial sequence
  Synthetic: STF-48
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcagttagaaagcgatgctgatggaatgggagatgcactagttgcagttaagcagccatatatcggctcaatagctttaactcaacatgataaaaataccaacttcatttcagccaaggatttcggtgcaacagctgacggaactctgcatccactcagcgagaaattctccacactatcagcggcgcaggctgtttatccattcgtaacatcactaactcagtctcttgactatgcaggcatacaggccgcaattaatacagggcggaatgtattattgacatctggaacttacttcgtaaatgcaacgatagagatgaattcaaactgcacaataaatggcgaaacaaacagcaacataaataggccggaaactttcatagcagtaataggaaatatagcttgtttccattaccacgcagcgtttaatacaataaatattgaaaatgtctatattttttacgatggaggacgccctacatcacctactggcaatgatggtaaaattggcattctaattgatggaggaactacttcaccaggcgttatgcacattaaaaatgttgaggttgatggtgcatggtgggccatatatgatgactctggaaattacctaacaaagtatacccaggtatgggcgaggagagttgcgcatggtttctataaggcgaacggaacgacaatacagtgggatacatgttatgtgctggatgcagcacaggcatggtatgttgtaaattgcctgtctcctcagctaataaactgtgcaggagaccagatcacagttgacgggtcgcaatatacatttgattcctcagggttatatttttctggatgtaagtgtcttactattacagggtatgatggtgagtctaatataataaaaaatacaaatggaattactgcgtcgtatataaaacttaatgatactattgcccatatatcaggattggccgggcatggaaactcaatgcaaacaacggggagtgggacagcagcatttatctttgcaacaggcacaagcattgttaacataaaatcaagtaccgatagcttccttgatagcgaatcaataacctacactggctctggatacccaaacacattgctgacagactcaacagcaaaaataattgctgagggatgccggtttaaggctccgactggtgggactcctgtaatatcaacttacagcacagggaatggagtatttactgactgctcattaactgggacgcaaacttcaggctcatatgttgaatcacgaagctctgcaggtaatcagttgccagcagtgtacacagcgaaaggaactcaggctgttgcagctaacgtagcaactacgttgtttgaactgccaaatagccaagggatgtacctgataagcgtttgggcagaaagcagtggaacaaatttctcttcgcttcagcttgccatgtgggacggaacaacacttactttaactccgcttaagtcaggagggttgatatcatttacagtgacaggaaggattgtaaccatcacaagccagggaacaacaacatttaactggacatacaccaaggcaggg

SEQ ID NO: 111 - DNA, 4095 bp, Artificial sequence
  Synthetic: STF-49
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggggctattggtgatggtgttcatgatgatacatcagctctatcagaattactttctgttgcaacaggtggtgaaaagatagatgggcgagggcttacttttaaagtatcaactcttccagatgtcagtcgatttaaaaatgctcgttttttatttgagagaataccgggtcagcctcttttttatgcttctgaagattttatccagggagagttatttaaaattacagatacaccgtggtacaacgcctggacgcaggataaaacgtttgtatatgacaatgtcatctatgcgccttttatggctggagaccgccatggtgtaaataacctccatgttgcatgggttcgctcaggagatgacgggaggacctggacaacgccggaatggcttacagatttacatgaaaactatcccacagttaactatcactgcatgagtatgggggttgtcagaaatcgcctttttgctgtaattgagacgcggaccgtgagcggaaataaactgcaggttgcagagttgtgggatcgcccaatgagtcgcagccttcgcgcttatggtggtataacgaaagcagcaaatcagcaagtcgcttatattcgcattactgatcacggattatttgctggtgattttgtcaacttctcaaactctggtgttacaggtgttaccgggaatatgacggtgactactgttattgataaaaatacttttacagttacgacgcaaaatacccaggatgtggatcagaataacgagggtagatactggagttttggtacatcatttcactcgtcaccatggagaaaaaccagtcttggaactattccttcttttgttgacggaagcactcctgttactgagattcacagttttgcgacgattagcgataacagttttgctgttggctaccataatggtgatattggtccacgcgagcttgggatactctatttctctgatgctttcggttctcctggtagctttgttcgcagacgcatacctgcagaatatgaggcgaatgcatctgagccatgtgtaaaatattatgatggcattctgtatctgacgaccagggggacattaagtactcaacccggtagttcattgcacagaagctctgatttaggtacatcatggaattctcttcgcttcccaaataatgttcatcactcaaaccttccttttgccaaagttggcgatgagctgattatttttggcagtgagcgcgcatttggtgagtgggaaggaggagaacctgataaccgttatgcaggaaactatccaagaacatttatgaccagagttaacgtcaatgagtggagtctggataatgtagagtgggttaatgttactgatcagatttatcagggcggaatagttaactctgcggttggtgttggttcagtttgtatcaaagacaactggctgtactacattttcggtggggaagactttctaaacccatggagcataggggataacaacagaaaatatccttatgttcacgatggtcacccggctgatttgtattgtttcagggtgaaaattaaacaggaagaatttgtttcaagggattttgtctacggagccactcctaacagaacgcttcctacttttatgtcgacgtcaggcgtgaggacggttcctgtacccgttgatttcacagatgatgttgccgtccagtcactgactgtccatgcaggtacatcaggacaagttcgcgcggaagtcaaacttgagggtaattacgccattattgcgaagaaagtaccgtctgatgatgttaccgctcagagattaatcgttagcggcggtgaaacaacgtcttcagcagatggtgcaatgataacgttgcatggttccggaagcagtactcctcgtcgcgcggtatataacgcactcgaacatctttttgagaacggagatgttaaaccttatcttgataatgtaaatgctcttggtggtccgggaaacaggttctcgacagtttatcttggctccaatcctgtggttaccagtgacggaacattaaagacagagccggtctctcctgacgaagcattgctggatgcctggggtgacgtcaggtatatcgcttataaatggctgaacgctgtcgctataaagggggaagaaggggcgaggatacatcatggtgtaatcgcgcagcaacttcgtgatgttcttatttctcacggactcatggaagaagaaagcacaacatgccgctatgcgtttctttgctatgacgattatcccgcagtatatgatgacgtcattactggccaaagggaaatgccgctgactgataatgacgggagcatcattgttgatgaggatgataatccagtgatggtaatggaagacatcattgagcgcgttgaaataacgccagcaggatctagatggggggtcagacctgatctcttattctatatcgaggcggcatggcagcgcagagaaatagaaagaataaaagctaggttagacttaatagaagggaagcac

SEQ ID NO: 112 - DNA, 3153 bp, Artificial sequence
  Synthetic: STF-52
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcagctagcaagctcagaagatggaatgggtgacgcactagttgcagttaagcagccatatatcggctcaatagctttaactcaacatgataaaaataccaacttcatttcagccaaggatttcggtgcaacagctgacggaactctgcatccactcagcgagaaattctccacactatcagcggcgcaggctgtttatccattcgtaacatcactaactcagtctcttgactatgcaggcatacaggccgcaattaatacagggcggaatgtattattgacatctggaacttacttcgtaaatgcaacgatagagatgaattcaaactgcacaataaatggcgaaacaaacagcaacataaataggccggaaactttcatagcagtaataggaaatatagcttgtttccattaccacgcagcgtttaatacaataaatattgaaaatgtctatattttttacgatggaggacgccctacatcacctactggcaatgatggtaaaattggcattctaattgatggaggaactacttcaccaggcgttatgcacattaaaaatgttgaggttgatggtgcatggtgggccatatatgatgactctggaaattacctaacaaagtatacccaggtatgggcgaggagagttgcgcatggtttctataaggcgaacggaacgacaatacagtgggatacatgttatgtgctggatgcagcacaggcatggtatgttgtaaattgcctgtctcctcagctaataaactgtgcaggagaccagatcacagttgacgggtcgcaatatacatttgattcctcagggttatatttttctggatgtaagtgtcttactattacagggtatgatggtgagtctaatataataaaaaatacaaatggaattactgcgtcgtatataaaacttaatgatactattgcccatatatcaggattggccgggcatggaaactcaatgcaaacaacggggagtgggacagcagcatttatctttgcaacaggcacaagcattgttaacataaaatcaagtaccgatagcttccttgatagcgaatcaataacctacactggctctggatacccaaacacattgctgacagactcaacagcaaaaataattgctgagggatgccggtttaaggctccgactggtgggactcctgtaatatcaacttacagcacagggaatggagtatttactgactgctcattaactgggacgcaaacttcaggctcatatgttgaatcacgaagctctgcaggtaatcagttgccagcagtgtacacagcgaaaggaactcaggctgttgcagctaacgtagcaactacgttgtttgaactgccaaatagccaagggatgtacctgataagcgtttgggcagaaagcagtggaacaaatttctcttcgcttcagcttgccatgtgggacggaacaacacttactttaactccgcttaagtcaggagggttgatatcatttacagtgacaggaaggattgtaaccatcacaagccagggaacaacaacatttaactggacatacaccaaggcaggg

SEQ ID NO: 113 - DNA, 2793 bp, Artificial sequence
  Synthetic: 1AR
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcgctacccgcgtgtccaaagaaggtgacactatgactggtaagctgactctgtctgcgggtaacgatgcgctggtgctgactgcgggcgagggcgcgtcctcgcacattcgctctgacgtgggcgggacgaacaactggtatatcggtaaaggcagtggggataacggtttaggcttctactcatacatcactcagggcggggtgtatattaccaacaacggggaaatcgctttaagcccgcagggtcagggtacgtttaacttcaaccgtgatcgtctgcacatcaacggcacgcaatggacggcacatcaaggcggtggctgggaaaaccagtggaatcaggaagcgccgatttttattgatttcggcaacgtgggcaatgatagctactacccgattatcaaaggtaagtccggcattaccaacgaaggttatatttctggcgtggacttcggtatgcgtcggattactaacacgtgggcgcagggtattatccgcgtaggcaatcaggaaaacggtagcgatccgcaggccatctacgagttccatcataatggcgtactgtacgttcctaatatggtaaaaacgggtgcgcgtctgagcgcaggtgggggggatccggtatggcagggtgcatgtgttgttatcggtgacaatgacacgggcttagtgcatggtggcgatggtcgcatcaatatggttgcaaacggtatgcacattgcgtcttggagttccgcgtatcatttacatgagggtttatgggatactacgggcgcgttatggacggagcaagggcgtgcaattatcagcttcggtcatctggtacaacaaagcgatgcctattccacctttgtccgtgatgtatacgttcgttcggatattcgcgttaaaaaagatctggtgaaattcgaaaacgctagcgaaaaactgtccaaaatcaacggttatacttatatgcagaaacgcgggttagacgaagaaggtaatcagaaatgggagcctaacgccggattaatcgcgcaggaagtgcaggcgattctgccggaactggtagaaggcgatccggacggtgaagcattattacgtctgaactacaatggcgtgatcggcctgaatactgcggcgattaatgaacatacggcagagatcgcggagctgaaaagcgagattgaagaactgaaaaaaattgtcaaaagcctgttaaag

SEQ ID NO: 114 - DNA, 780 bp, Artificial sequence
  Synthetic: 1AR-AP1
atggcagtaacaggaccgtgggtaggatcgtctgcagtagttaatacaggacaaaattggatggtcggcgcggcccaacgattaagaatgggtgctccgttctggatgagcaacatgattgggcgctctgttgaagtgattcatacgttaggcgcagatcataattttaatggtcaatggtttcgtgaccgttgctttgaggcgggcagtgcgccgatcgtgtttaacatcactggcgatttagtttcttactcccgtgacgttccgctgtttttcatgtatggtgacacgccgaacgagtatgtacaattaaacattcacggtgtcacgatgtacgggcgcgggggcaacggttgggcggcgggtgcaatcggtgcgagcgatggcggggtgtgcatccagaatgatattggaggccgactgcgtatcaacaatggtggggcaatcgcgggcggtggcggtggtgggggtggttattctcaggctaacaattgggcaggtaagtacgtttgcggtggcggtggcggtcgtccgttcggcttaggtggcaacaacggtgcgcgttggcctgggggcaacgctagcctgacctcgccgggcgcaggtgggaacactggcacgcgttattacgctggcgggggaggtgaggttggtcagccgggtcagtatgcaaaccccggcgcgggttactccaccccaccaacgtcgccgggcgcggcagttgcaggtagtgcgccaacttggcaaaacgtgggcgctatttatggcccgcgtgtttaa

SEQ ID NO: 115 - DNA, 243 bp, Artificial sequence
  Synthetic: 1AR-AP2
atgagtgaacagaccatcgaacaaaaattaagcgcggaaatcgtgactctgaaaagtcgcattctggatactcaggaccaggcagcacgtctgatggaagagtctaaaatcttgcagggcactctggcagaaattgcccgtgcggtgggtatcacaggcgacacgatcaaagtagaagaaattgtggaggccgtaaagaatctcacagcggagagcaccgatgaagcaaaagacgaagaataa

SEQ ID NO: 116 - DNA, 2706 bp, Artificial sequence
  Synthetic: 13-13.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 117 - DNA, 780 bp, Artificial sequence
  Synthetic: 13-13.0-AP1
atggcagtagttggagttcctggctggattggaagttcagccgtaaatgaaacgggtcagcgctggatgagtcaagcagctggtcaattaagattgggtgttccttgctggatgagtcaatttgcaggtcgctcaagagaaattattcatacacttggagcagaccataacttcaatggtcaatggttccgagatagatgttttgaggcaggtagtacacctatagtgtttaatatcactggagatttagtatcatattctaaagatgttcctttattcttcatgtacggagatacaccgaatgaatatgttcaactgaatatacacggcgtaacgatgtatggacgtggcggtaatggcggtagcaatagtcctggttcagctggaggtcattgtattcaaaacgatattggtgggagactaagaattaataacggtggagctattgccggcggcggcggtggcggcggtggcggtagatatggcagactatcatttggtggtggcggtggtcgcccattcggtgctggcgggtcttcctctcatatgagttccggtgcaactgctggcaccatttccgctccgggtgcaggatctgtcggtgagggatctctttgggtatatacaggcggttcgggtggtaatgtcggtgctgctggaggaagatgtaatattcaaggtaacggtacagaatatgatggcggtgctgctggttatgctgttatagggtctgctccaacttggataaatgttggagcaatatatggtccaagagtataa

SEQ ID NO: 118 - DNA, 243 bp, Artificial sequence
  Synthetic: 13-13.0-AP2
atgtctgaacaaactattgaacaaaaactgtctgctgaaatcgtaactctgaagtctcgtatccttgatacgcaggaccaagcggctcgtctgatggaagaatccaaaattctgcaaggaactttggctgaaattgctcgtgcagtaggtatcactggcgatactatcaaagttgaagaaatcgttgaagctgtcaagaatcttactgctgaatctgcagatgaagcaaaagatgaagaatga

SEQ ID NO: 119 - DNA, 2283 bp, Artificial sequence
  Synthetic: 13-14.3
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtatttctgatgatattggatggatgcattatattcaacgaaataaagataatacagttgaagccgtattaaatggtcaacagacaattaacgaaaatattattgcgaaaaaggatatttgggttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattc

SEQ ID NO: 120 - DNA, 777 bp, Artificial sequence
  Synthetic: 13-14.3-AP1
atggcagtagttggagttcctggctggattggaagttcagccgtaaatgaaacgggtcagcgctggatgagtcaagcagctggtcaattaagattgggtgttccttgctggatgagtcaatttgcaggtcgctcaagagaaattattcatacacttggagcagaccataacttcaatggtcaatggttccgagatagatgttttgaggcaggtagtacacctatagtgtttaatatcactggagatttagtatcatattctaaagatgttcctttattcttcatgtacggagatacaccgaatgaatatgttcaactgaatatacacggcgtaacgatgtatggacgtggcggtaatggcggtagcaatagtcctggttcagctggaggtcattgtattcaaaacgatattggtgggagactaagaattaataacggtggagctattgccggcggcggcggtggcggcggtggcggtagatatggcagactatcatttggtggtggcggtggtcgcccattcggtgctggcgggtcttcctctcatatgagttccggtgcaactgctggcaccatttccgctccgggtgcaggatctgtcggtgagggatctctttgggtatatacaggcggttcgggtggtaatgtcggtgctgctggaggaagatgtaatattcaaggtaacggtacagaatatgatggcggtgctgctggttatgctgttatagggtctgctccaacttggataaatgttggagcaatatatggtccaagagta

SEQ ID NO: 121 - protein, 1064 aa, Artificial Sequence
  Synthetic:  K1F phage
MSTITQFPSGNTQYRIEFDYLARTFVVVTLVNSSNPTLNRVLEVGRDYRFLNPTMIEMLVDQSGFDIVRIHRQTGTDLVVDFRNGSVLTASDLTTAELQAIHIAEEGRDQTVDLAKEYADAAGSSAGNAKDSEDEARRIAESIRAAGLIGYMTRRSFEKGYNVTTWSEVLLWEEDGDYYRWDGTLPKNVPAGSTPETSGGIGLGAWVSVGDAALRSQISNPEGAILYPELHRARWLDEKDARGWGAKGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 122 - DNA, 240 bp, Artificial sequence
  Synthetic: 13-14.3-AP1
atgtctgaacaaactattgaacaaaaactgtctgctgaaatcgtaactctgaagtctcgtatccttgatacgcaggaccaagcggctcgtctgatggaagaatccaaaattctgcaaggaactttggctgaaattgctcgtgcagtaggtatcactggcgatactatcaaagttgaagaaatcgttgaagctgtcaagaatcttactgctgaatctgcagatgaagcaaaagatgaagaa

SEQ ID NO: 123 - protein, 1083 aa, Escherichia virus Lambda
  misc_feature: lambda phage
MATLKQIQFKRSKTAGARPAASVLAEGELAINLKDRVLFTKDDQGNIIDLGFAKGGSIDGNVIHIGNYNQTGDYTLNGTFTQTGNFNLTGIARVTRDIIAAGQIMTEGGELITKSSGTAHVRFFDGNSRERGIIYAPANDGLTTQVLNIRVQDYAAGSESTYAFSGSGLFTSPEVSAWKSMSTPQILTDKVITNGKKTGDYDIYSLSNNTPLAESETAINHLRVMRNAVGAGIFHEVNVNDGITWYSGDGLDTYLWSFNWAGGLKAGHSISVGLPGGSKGYSELGTASIALGDNDTGFKWHQDGYFHTVNNGTRTFIYGPAETQSLRKMVMGYSPDGILMTTPPTENYALATVVTYHDNNAFGDGQTLLGYYQGGNYHHYFRGKGTTNINTHGGLLVTPGNIDVIGGSVNIDGRNNNSTLMFKGYTMGQSSVDNMYIAVWGNTFTNPSEGTRKNVMEISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 124 - protein, 1054 aa, Artificial Sequence
  Synthetic:  WW11 phage
MNAHTPFDANQDWTNPYCQNSSNDPMVDALLGNAYHVVRTVYCNLGNLKLIYDFLNQYGMVLGVQSEAELKALTTKASFARIYDKTPAGDRQVTDYLYVEGDRTGILPDDTTATGSWVKVATTGSDNGGDKSNDGGYIPWIYNSGSANGGETTIRIPDETAGAPFMIVNGDWQTEGYDFEYDPVTFEVSFTTPLEPGDFVVVMRTGVPATPDNPNVSDWVTINWLYNQGAAVGGEQVIDIPYTFQSVPAVYKNGLRFYKGLTNNSYTVDSDNNRIILTEPLATNDRLIVQLGGEAKVLKVVDHTIQEVARSANVKDSQVILSVDTVQSLNGKAVVYDVVAQRIYGLPTLPSNVYINTVANGKLYYNPGNVEVTLLDVPGSGTEVKSALAKQDGLSLIGQCNSIADLRNVEPVMDGQRILVKQHTAGTGKGGGTFQAKLSGVGLTDDNGVTVKTVGGAAWVRVGADRVNPYMYGALGSGNDDTLAVQACLNSGKATNITDVHHVSNVTMNKSSASIYGSGLHYTRLHQLPAAVGSLLTIADTCSLTVIDSLGLYGTGYKQGTAFTTGTRGIDVLTPTGLSNNYPDHTTSDPRRDLVITKVHIAGFDEYGLNVDSGNFSVTTESVLINHIKQVGARCATTDWTWTNIQINTCGKQCLILDGCGNGRIIGGKFIWANWLPYGASGQFPGITINNSQNMVINGIEVQDCGGNGIEFTDSYSISMNGLNTNRNGINSTAEFYNLVFNRSDVEINGFVGLNYKVNSGSPDNSSSGNLKFLSSDCNVTLNGKLETGYMGIEFIGDTRVIQPTSSYIKLNGLVNYAGSGIQTINEVPTFDGVSTTPVYVPISSVVGQTNGLRLSQANKDKVIYTRKVGPEGVTMAAVITPTIGGAEIFNLMAIGTGFSSASNSLYFQLEIAADGSQNVSLLLSGDGTTQILPGTLPAALKLQSGEPYHVALGAKAGYFWWSILNLNTGKRIRRSFRGAYLPKPFASIFGLVSSPVFFSGAGIGDSGCSGVGAKIYLGSFSDENDYVSSRYYSLVNPVDPTKMYSFRILDSTI

SEQ ID NO: 125 - protein, 630 aa, Artificial Sequence
  Synthetic:  WW11 phage
MNEMFSQGGKGSTGILTNKQAVARHFGVKQSEVVYFSVGAVLSGYKVVYDKESQRAYSLPADIGSGVTAVSLSPAGVLVHSAGNVDLGALAVTREEYVTLPGSFDTGVTVNTKNELVVFTDGKYRWEGALPKVVAAGSTPESTGGVGVGLWKSVGNASLRDELSNNDGFNLIGAAYYNDVRGYTGDGDKIICAGRENITDGCSGVFFLDHSDNTSADNDGTVLVDSLGRRWKRQFDGTAQRRWFGLPDNEGLTSGWDSYAPSQEKSLKDAVQDIAVTPDDVCVKHRAIKAFRKSVGIKDSAVAGAFIVGEFPEDSNVEPSASVTGFESYDDIGKYPGRDSVALFAQAESALPLEFSDGVFTSESVTSPTILSVIGKVQPGMILDVNFGTGGWVGTVITAVNTSTGELTISGWRKIDGSSSVAATPANNTPAVINRHNNLWAANFNALTTPNGGANQAIGIETGLSLLKTGSGIGSKAYYAVNLSSGTGEDPQYGFMNGGQFQKVFFAQLATDCSFESTVLANTNAKHCNFHATNGTSLFRVGYTGLEVQTLAIEYMSSTGTVSEASALTIATAADININLDVAANFPGRLRKIKNASGGAITVNGGVALTDGMYAEFISDGSTWITLFTK

SEQ ID NO: 126 - protein, 980 aa, Artificial Sequence
  Synthetic: K1F phage
MADLSRIQFKRTSTKGRRPDAGTMNPGELAINLADQYLLTKNDSGAIINLSCPPVYDSDVTMAGKVKGNNYILSKTANYFEDQTARDLNYFGAFRPNNADDWSNLILNIPHPSGKAHGRGFEFQYGSSSSQVKTYGFDKDGNKRFSFRMYHEGDKPTPGELNVYSKQEIDRMFVKNVKMSTPSGEATRGYFKIASAMIPQSGRMAFLRIYGGNGFNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSAIPGSYKGYVITGKMELHGSGNSMILHRQTAQAAYMSWWDRRDGKNQRSGYIGHADGTSDAIVWNNDIGQNSAVLETSGQISFRTGATKIVYTNGQYYSANSDAYRMIFGNYGAFWRNDGTKVYLLSTAENDKYGGWNAYRPFIYDLTSGNVQLGGDGNEDALTLECASRAARFSNDVYIKKGLLTFDAGRAGSRDYIRFNHWGDSNNARDNVLCIEDSQGRHFSTERAMGTGALKAYFLGDLEVGGKFTWGKNTATSSFNIRAWGNDSRKQVLECADESGWHWYTQRTGGPDTSAIDFAINGTVRPQAIHTGGNITINGADIEFKRTGNKHIWFRDPNGLELGLMYCDDAGAIRFRGQKQAQAWKFADKMIQLESGTVSGGGNGLIRGEVAGGSWASWRDRAAGLMVGCPQSTNSAHNVWKATHWGKYHIAAMAVHVPDGTITNALARLNVHDANFDFSASGDLSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 127 - protein, 1036 aa, Artificial Sequence
  Synthetic: CBA120 phage
MANKPTQPLFPLGLETSESSNIKGFNNSGTIEHSPGAVMTFPEDTEVTGLPSSVRYNPDSDEFEGYYENGGWLSLGGGGIRWETLPHAPSSNLLEGRGYLINNTTGTSTVVLPSPTRIGDSVTICDAYGKFATYPLTVSPSGNNLYGSTEDMAITTDNVSATFTWSGPEQGWVITSGVGLGQGRVYSREIFTQILASETSAVTLNTPPTIVDVYADGKRLAESKYSLDGNVITFSPSLPASTELQVIEYTPIQLGNGGGSGSSTITWVYNGGSAIGGETEITLDIVVDDVPAIDINGSRQYKNLGFTFDPLTSKITLAQELDAEDEVVVIINGTPNIYNQIDYTLREVARVTNVKDTEVIYFSVGAVLSGYKVIYDKVTQRSYFIPELPTGTTAVSLSSSAILVHSAGSVDLGALAVSREEYVTLSGTFDSGAVINTKNELLTHTDGKYRWDGTLPKTVAAGSTPATTGGVGSGAWLSVGDASLKSNLNKPNGLSYIGTVSSVSELSSIAGLIGDSIILDSYVDGFNLGGGVMVAVNSDTVVDNIVTFQGNGVVWKRKLFNGVADVYEAGYTGTGDLAIFINKINAVGFDCIVPVSGEITTPIIFDIAKGALIGKNKCTLIESASATGDYYLTIVNTDTDYTNRDVINATALMTGVSFVGKGTRKLAIGGSTSGEVSELRISNCGFISTAGIEFLDNAYRILFDKCALSRSFTNSVIFNSPANSGEVIKFNHCWMVDNGGPFTFKNGQFIFDSCSLPAGKKSGYFDPVVALSDNATTVFTNGNIEYQPGQSFVGFTVDGSSRLSISDSTILLPNDYSTVPIVNNGDGVVSLNNCSLPLYGSTTIATGFATRQLIGGLSKKIMSRGCYPRAGFITSNWNLGCIVSPYINSVSNGSGQFENISNWTLSQTGTDVVTVTTGNDVPNDLMFSTSFVLSVPTVGAAANFTQTIIDCEPGRYFQLGFWAKNTTTTLASIRFLDQQGNAVADSIGYNIPVGNTFNFYALVDCVPPGAYKAEINFNVSSIVGGIAIHNVIYGLI

SEQ ID NO: 128 - protein, 627 aa, Artificial Sequence
  Synthetic:  CBA120 phage
MISQFNQPRGSTSIEVNKQSIARNFGVKEDEVIYFTAGIDLSGFKVIYDESTQRAYSLPFGIVSGTTAISLDERAILTHSAGSVDLGELAVSREEYVTLPGSFNFGHTINVKNELLVHDDKKYRWDGSLPKVVAAGSTPDSSGGVGLGAWLSVGDAALRAELNTKVSDGTFPATIKYKYGLPSVIDGAIYRTVQDKLDDFVFLEDFGGKDDAGSTDNSIAFRKAFASGARKIRLRGSGVYGMATRDIELPAKYEIIGNAKNPEIKYLGTDTSFTMFTLTGSGPASNQWKQGGMFRDLIISSDVKINWMLGRHVQNLDYDRVFFYNSATVLNNYHYVNFTRCERWGSAFIGRADLNTIQFISESPKFHLCFSSGSPIDVWDTADLAITKCTMFAGDYAVRTRVTQKQVTAPDLFAGYPVLITCSVFDAVRGHAWDLEGSVYSTITGNLVSAGRDTNSHGAYIKGGRSLSLTGNVFTYCGNYGLVLEDVQQSGFVGNVFNGNKTGGLGTLACKDLSIVGGSMGTTYVRGGYYTQPVGYSDISSNSTGILLSGVAFDEALTTKVYLDTSITTRNKVINCSGVPDTIARGSTANRPANPQASYQYYDTTLGIPIWWNSVSGTWKNAAGADV

SEQ ID NO: 129 - protein, 921 aa, Artificial Sequence
  Synthetic:  CBA120 phage
MTRNVEELFGGVITAPHQIPFTYKSNVGGETFLSLPFYPVTGVVTINGGMQVPLDNFEIEGNTLNLGRALSKGDVVYCLFDKILSPEDTAKGIRIYKFQAVGGETEFTPDFTSYGVQSLYIGGEYKTPEIEYSYDSTTGKVSLQTALSAGVWVVAEMSVKQPNISPAFDRSIQEIARSANVKDSEVIVSTDTISLLDGKKVVYDIATQTSYGLPTIPDGSVISSVSAGKLNYNPGDVQVDLLPLEDSFINVINTLGRNDGAKYIGECHSVADLRNTEPTMDGQRIILKQHTAGTLLGGGVFRALIDGTGKTDNNGTVIKTVGGAAWLRVNADRVNPFMFGALGGSNDDTIPVQSCVDSGKATQLTDAHYVSNIQLKYNTSSIYGSGLHYSRLHQLPSATGNCITIKDTCSLIVLDAFGVYGTGAQQGTSFTAGTTGIYVETPSGLSADYPFHTTADPRRDLCISKVHIAGFDEYGLNIDSGNFSVTTDSLLVNHINQVGVRCATTDWTWTNIQVNTCGKQCLVLDGCGNGRIIGGKFIWANWQPYGTVGQFPGITINNSQNMVINGIEVQDCGGNGIEISESYSISMNGLNTNRNGINANNTFYNIVFNKSDAVINGFVGLNYAANSGSGANSSAGNFQFLSNDCSVTINGVVETGYMGINFIGDNNIINPTNSDLSINGLVNYSKTGLQTMNETPTFDGVSTTPVYVSVPSSVGQVNGLRLSQANKDKLLYSRTAGPEGITMAAVIVPTISGAEVFNFMAIGSGFSDTSNSLHLQLVIDASGKQTIALLLGGDGTTQILSGDLPNDLKLQSGVPYHIAIGAKPGYFWWSILNIQTGKRIRRSFRGAYLAVPFNSIFGLTSSLTFFSDSNAGGDACSGVGAKVYVGMFSSENDYVASRYYNLINPVDPTKLISYRILDSSI

SEQ ID NO: 130 - protein, 770 aa, Artificial Sequence
  Synthetic:  CBA120 phage
MNEMFSQGGKGSTGILTNKQAVARHFGVKQSEVVYFSVGVDLGGYKVIYDKETQRAYSLPVGIASGTTAVSLSTAAVLVHSAGSVDLGSLAVSREEYVTLPGSFDSGSTLNVKNELLTYTDGKYRWDGILPKTVAPGSTPASTGGVGLGAWISVGDASLRTQLANGDGSLIGIHPQGTLNNVLTVRTPEQYNAVGDGIADDTSKLKEMLSDINNVPETLPDAAAVNSYMEQVAVKIDLTKLYRFTETLYIPPGVSIEIPTSNFFTRECKQGLFYDPVDKNTAAISLMVYRKQPDGSYKLNKDVDYYPTGLDIDNGDAITCARKIDINNLNLITAPGVKVGVKWIGGAGCTTKGLSIGENTGSDITTARLPRVGLLQSASWGSIHENLRILYKTQGAVFIDSNGGAAVNNAYISRLGNTNGELEQAVYKPAGFTEVGDVAVTQFAGSEVKFNSPIIEQASFDFVHAGRDTDSYGLFMVDKPHIESSGGKKKHSFYLINTSSNVTLSGVGLSGQDPDLDSMYFLKNCPETARNVVRGQMPISGVKLVRGTGNYPTLVLDCTNMGSQFQFGEVGDIFYIKDVVGVKADTLYIDPVNGNNYNWGTNGTKPIRELTNIAKICQLFRCKSVYLNAGESVITSNTELPMVVFEGPGSLKANSGSSFLIKAGGTLSLIGLSGISTDGGHMFRVSTVEKVNIHTNCSVNAGAAYVVLSEVQGNIEYRQLFYSVNCSKYIGATAGQTIAGIMVKTATRPTGIDAAPVDGNVSLTYKIIES

SEQ ID NO: 131 - protein, 166 aa, Artificial Sequence
  Synthetic:  CBA120 phage
AEDEVVVIINGTPNIYNQIDYTLREVARVTNVKDTEVIYFSVGAVLSGYKVIYDKVTQRSYFIPELPTGTTAVSLSSSAILVHSAGSVDLGALAVSREEYVTLSGTFDSGAVINTKNELLTHTDGKYRWDGTLPKTVAAGSTPATTGGVGSGAWLSVGDASLKSNL

SEQ ID NO: 132 - protein, 167 aa, Artificial Sequence
  Synthetic:  CBA120 phage
MISQFNQPRGSTSIEVNKQSIARNFGVKEDEVIYFTAGIDLSGFKVIYDESTQRAYSLPFGIVSGTTAISLDERAILTHSAGSVDLGELAVSREEYVTLPGSFNFGHTINVKNELLVHDDKKYRWDGSLPKVVAAGSTPDSSGGVGLGAWLSVGDAALRAELNTKVS

SEQ ID NO: 133 - protein, 241 aa, Artificial Sequence
  Synthetic:  CBA120 phage
MQIPFTYKSNVGGETFLSLPFYPVTGVVTINGGMQVPLDNFEIEGNTLNLGRALSKGDVVYCLFDKILSPEDTAKGIRIYKFQAVGGETEFTPDFTSYGVQSLYIGGEYKTPEIEYSYDSTTGKVSLQTALSAGVWVVAEMSVKQPNISPAFDRSIQEIARSANVKDSEVIVSTDTISLLDGKKVVYDIATQTSYGLPTIPDGSVISSVSAGKLNYNPGDVQVDLLPLEDSFINVINTLGR

SEQ ID NO: 134 - protein, 163 aa, Artificial Sequence
  Synthetic:  CBA120 phage
MNEMFSQGGKGSTGILTNKQAVARHFGVKQSEVVYFSVGVDLGGYKVIYDKETQRAYSLPVGIASGTTAVSLSTAAVLVHSAGSVDLGSLAVSREEYVTLPGSFDSGSTLNVKNELLTYTDGKYRWDGILPKTVAPGSTPASTGGVGLGAWISVGDASLRTQL

SEQ ID NO: 135 - protein, 1083 aa, Artificial sequence; identical to SEQ ID NO: 123
  Synthetic: WW13

SEQ ID NO: 136 - protein, 1103 aa, Artificial sequence
  Synthetic: PP-1
MATLKQIQFKRSKTAGQRPAASVLAEGELAINLKDRVLFTKDDQGNIIDLGFAKGGSIDGNVIHKGNYNQTGDYTLNGTFTQTGNFNLTGIARVTRDIIAAGQIMTEGGELITKSSGTAHVRFHDSADRERGIIFSPANDGLTTQVVNIRVQDYKASSESTFAFNGNGLFSSPEVFGWKSVSTPVIYTNKVITNKKVKDDYDIYSMADNVPLSEITTAINHLRVMRNAVGSGIFHEVKDNDGITWYSGDGLDAYLWSFTWSGGIKSSHSISIGLTPGPKDYSILGPSSIALGDNDTGFKWHQDGYYFSVNNGTKTFLFSPSETTSLRKFVAGYSTNGTDLTTPPTENYALATVVTYHDNNAFGDGQTLLGYYQGGNYHHYFRGKGTTNINTHGGLLVTPGNIDVIGGSVNIDGRNNASTAMFKGNTTGSSSVDNMTISVWGNTFTNPSEGNRKNVMEISDATSWMSYIQRLTTGEVEMNVNGSFESSGVTAGNRGVHTTGEISSGAVNALRIWNADYGVIFRRSEGSLHIIPTAYGEGKNGDIGPLRPFSIALDTGKVVIPDLESSYNTFAANGYIKFAGHGAGAGGYDIQYSQAAPIFQEIDDAAVSKYYPIVKQKFLNGKAVWSLGTEINSGTFVLHHLKEDGSQGHTSRFNADGTVNFPDNVQVGGGEATIARNGNIFSDIWKTFTSAGETTNIRDAIATRVSKEGDTMTGKLTLSAGNDALVLTAGEGASSHIRSDVGGTNNWYIGKGSGDNGLGFYSYITQGGVYITNNGEIALSPQGQGTFNFNRDRLHINGTQWTAHQGGGWENQWNQEAPIFIDFGNVGNDSYYPIIKGKSGITNEGYISGVDFGMRRITNTWAQGIIRVGNQENGSDPQAIYEFHHNGVLYVPNMVKTGARLSAGGGDPVWQGACVVIGDNDTGLVHGGDGRINMVANGMHIASWSSAYHLHEGLWDTTGALWTEQGRAIISFGHLVQQSDAYSTFVRDVYVRSDIRVKKDLVKFENASEKLSKINGYTYMQKRGLDEEGNQKWEPNAGLIAQEVQAILPELVEGDPDGEALLRLNYNGVIGLNTAAINEHTAEIAELKSEIEELKKIVKSLLK

SEQ ID NO: 137 - protein, 980 aa, Artificial sequence
  Synthetic: WW55
MADLSRIQFKRTSTKGRRPDASTMNPGELAINLADQYLLTKNDSGAIINLSCPPVYDRDVTMAGKVKGNNYILSKTANYLEDQTARDLNYFGAFRTNGLDGLLELTLNVPHSSGVQHGRGFTFQYGHTGSRVETYGYNKEGQKAFSYKMYHEGDKPTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKK

SEQ ID NO: 138 - protein, 980 aa, Artificial sequence; identical to SEQ ID NO: 126
  Synthetic: WW34

SEQ ID NO: 139 - protein, 1302 aa, Artificial sequence
  Synthetic: WW14
MATLKAIQFKRSKTPGAKPTVDQLVEGELAINLRDRTIFTKSDQNQIIDLGFAKGGQVDGDVTINGTLNLNGPEIVASGGYIEFNYRTTGSGSWAGQHAAKAPIFVDLSAALSTSEYNPLFKQRYKDGTFSAGTLVTEGSFKFHYINEAGDSKYWTFNRNGNFQVDTGSLFVSGGNISASGNINSASGFVSAPQINTKNIILDTKAFGQYDSQSLVNYVYPGTGETNGVNYLRKVRAKSGGTMWHELCTAQLGQADEMSWWTGNTPQSKQYGVRNDGRLIGRNSLALGTMTTDFPSSDYGNTGAMGDKYLVLGDTATGLKYIKQGNFDLVGGGYSVASITTDGFRGTSKTLFGRSNDQGLTWLLPGQNSAMVSIRTEIDGNNSGDGQTHLGYNSNGKLYHYFRGTGRVAISMAEGMIIEPGILNIKTGVNELNLRADGTVSTTQRLMVNNGLVLNANNNTSALALTAPTGVDGTKTINWDAGTRNGQNKNTVTMKAWGNSFNAGGGNRETVFEVSDSQGYYFYGQRTNPASGETVGPINFKFNGSVETGHFSSLGNISASGTGSFGGNVTMTNGLFVQGGASINGQVKMGGTADALRIWNAEYGMIFRRSETGSSASFHLIPTLQNAGENGGISDLRPLSINLASGTVIMGNKSTGGPLFTVDNVSKFVQTDCRLRVNMDSDGIVLNASSQAASNFIQGRKADVTKWYLGIGDGGNVVRMHNYTYSHGIALNSDTVDITKPLKIGSDIRIGTDGNIIGSATLDNFKNLNTTLDHKVNMGGWSGGATTGWYKFATVEIPQATGTASFKIFGGSGFNFKSYGQASIAEIILRTGNNNPKGLNATLWNRTSEAISQIASVNTSEDIYDIYVYLGGYSNSLVVEYTCSSNSKVTVVGMDGGVQPLVETLPEGHVVGKSVRMLNNLDGMFAAGESDIVTRGEYVTNNQKGMRIKSKGNDLDSNAALLRNDGGSFYILATDKNTTEKPDAANGDWNGLRPFSINMADGRVGMNHGLNITGGGLNVTGGNTNLGNITSRVVSSARAGSGWGDNSDAMKSKITFMADHGDLSNSGSYYPIVGAYSNYGSAGYRQTFEFGWVGSGSTANWREGIIRIRGDNANGQQARWRFTMDGILGCPGKVEMPETSAFGINTTNGFGGNSIVIGDSDTGFRQVGDGLLEVWTNASRRMRFQGGDTYSDMNINAPNVYIRSDIRLKSNFKPIENALDKVEQLDGLIYDKADYIGGEVVHTEAGVIAQSLEKVLPEAVREVDDIKGNKVLTVSTQAQVALLIEAVKTLSAKVKELEAKLN

SEQ ID NO: 140 - protein, 976 aa, Artificial sequence
  Synthetic: WW170
MADLSRIQFKRTSTKGRRPDASTMNPGELAINLADQYLLTKNDSGAIINLSCPPVYDRDVTMAGKVKGNNYILSKTANYLEDQTARDLNYFGAFRTNGQDGLLDLTLNVPHSAGVNHGRGFTFRYATGGSRVETYGYNAQGQKAFSYKMYHEGDKPTPSELNVYSKQEVDRMFVKTVKLATVPVDIVDGYFKLATAMIPQNGRSVFFRIHGGNGYNVTAYDQVDIVEIVIRSGNNRPKGVNVIAYRRNTNKAFDVLAVNTSGDNYDIYVKYQRYTDNVIVEFGKSVDVDLVVHDVPDFVVDRPVGDNVIGGRAVTLFNTENKRGVLSFDDNTQNSYDIVHLSNDRGTGRKYIRKFRSNYNEMIWHETVQGSTYRLATGSTDAQEILSVESSSSIAGTHKGNILSGRMMLGGGSNVITLRRPAGQSNHIAFQDNRTGSITRQGWIGYGNADTNVFEWYSDVGGTSIRHHIDGQIELATGNTKRVYTNAQFISMNSDAYRMIFGNYGAFWRNDGTKVYLLSTAEDDKFGGWNGNRPFIYDLTNGKVTLGGDGNEGALVLERDSRAARFAGDVYVEKGFLHFSSGRQGASGFMKINHLGDIASGRHNILQIEDPTGIHFSTERNDETGNITARFKGFVRVEAGEIAFDANRGSQSQFTLHTWGNEQRKQVFECKDATGYHWYTERTQGGTGNVLFSMAGSLNVTSNITTTGADITFKRAGNKHIWFRDPDGLELGLMYCDDAGAIRFRGQKQAQAWKFADKMIQLESGTVSGGGNGLIRGEVAGGSWSSWRDRAAGLMVGCPQSTNSAHNVWKATHWGKYHIAAMGIHVPDGTIGNALARLHVHDTNFDFSASGDMTAGRNGSFNDVYIRSDARLKINKEEYKENATDKINRLTVYTYDKVKSLTDRTVIAHEVGIIAQDLEKELPEAVTTSKVGDPDKPEEILTISNSAVNALLIKAFQEMSEELKAVKAELAELKKN

SEQ ID NO: 141 - protein, 966 aa, Artificial sequence
  Synthetic: WW202
MADLNRIQFKRTSTAGRKPDAGTMNPGELAINLADQYLLTKNDDGQIVNLSCPPVYDKGFDVRGRVVVDDLVWSNTANYFDDPTARNLDKFGAFRTNDMDGHLAFALHIPHPSGINHARGFDFTYGSNVVPTVKTYGYNADGVLAYSYRMYHEGDKPSPSELNVYSKQEVDRMFQKTINFGVETGWFKIATAFIPQNDGRSLKIRLVGGNGWNVGQTGQCNIIELVIRTSNGSPKGINFVAYHHVSGYENQFCAINTGDDTYDIYAYYYEFTNMVMAEYQASSDVNLTVFDRPEYVGEKPVAEHIFDAYTIHSFNSFSNRGTLNFAGNHQGQYDIEHMNEQPTNAKKMLRRFRSSASATIWHETVDDQNYRLATGGTDSVQQLLLSSGTGLHIRRLTIDGGLGSGSNAGIDIRRGPNESSHFNFMDYRTGQDVRNGWFGFGDLTTKDFIWWNDNGQNSINLIENGELHITGGRGQKIVMNSEVALSENARLAVKGGNYGLILRNDGTGFHILTTDLKDSFGSWNNRRPFSYNFADGGLYLGGTETARCLHLGIDGSTRLEDNLFFKAGSRQSMDYMELVHWGASNTGRNNVLSLRDSKGFLAEFERVGGTDGVKTRFFGETFTDGTLYLNQMNNSSERFSINNWGNSEVGRAAVMEVGDSKGYHFYAERRTDDTVLFDVSGALTVHGPNGITVKNSTGARHIWFRDDSDTEKAVIWATDDGMLHIRNNHEGSFAHHFQGAMIKLEGRVPYGAAKGLIRGEVDGGAYVAWRDRPAGLLVDCQKSIDSAHAVWKAVDWGRQYIAAMDVHCPGDGNNTAAAVLHVQAADYQFHASGEFHASGNGNFNDVYIRSDRRLKDNIEDYTGNALSLIGKLKVKTYDKVKSLKDREIIGHEIGIIAQDLQEILPEAVKSSKVGNLDNPDDVLTISNSAVNALLIKAIQEMSEEIKELKTPFFTKIARKISKYFKF

SEQ ID NO: 142 - protein, 901 aa, Artificial sequence; identical to SEQ ID NO: 56
  Synthetic: WW13 13.0

SEQ ID NO: 143 - protein, 979 aa, Artificial sequence
  Synthetic: WW13 10.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 144 - protein, 1432 aa, Artificial sequence
  Synthetic: WW13-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGNIIDLGFAKGGSIDGNVIHIGNYNQTGDYTLNGTFTQTGNFNLTGIARVTRDIIAAGQIMTEGGELITKSSGTAHVRFFDGNSRERGIIYAPANDGLTTQVLNIRVQDYAAGSESTYAFSGSGLFTSPEVSAWKSMSTPQILTDKVITNGKKTGDYDIYSLSNNTPLAESETAINHLRVMRNAVGAGIFHEVNVNDGITWYSGDGLDTYLWSFNWAGGLKAGHSISVGLPGGSKGYSELGTASIALGDNDTGFKWHQDGYFHTVNNGTRTFIYGPAETQSLRKMVMGYSPDGILMTTPPTENYALATVVTYHDNNAFGDGQTLLGYYQGGNYHHYFRGKGTTNINTHGGLLVTPGNIDVIGGSVNIDGRNNNSTLMFKGYTMGQSSVDNMYIAVWGNTFTNPSEGTRKNVMEISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 145 - protein, 259 aa, Artificial Sequence; identical to SEQ ID NO: 57
  Synthetic:  Ww13 phage

SEQ ID NO: 146 - protein, 80 aa, Artificial Sequence; identical to SEQ ID NO: 58
  Synthetic:  Ww13 phage

SEQ ID NO: 147 - protein, 931 aa, Artificial sequence; identical to SEQ ID NO: 53
  Synthetic: PP-1

SEQ ID NO: 148 - protein, 259 aa, Artificial Sequence; identical to SEQ ID NO: 54
  Synthetic:  pp-1 phage

SEQ ID NO: 149 - protein, 80 aa, Artificial Sequence; identical to SEQ ID NO: 55
  Synthetic:  pp-1 phage

SEQ ID NO: 150 - protein, 1217 aa, Artificial sequence
  Synthetic: WW55 3.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKK

SEQ ID NO: 151 - protein, 1330 aa, Artificial sequence
  Synthetic: WW55-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGAIINLSCPPVYDRDVTMAGKVKGNNYILSKTANYLEDQTARDLNYFGAFRTNGLDGLLELTLNVPHSSGVQHGRGFTFQYGHTGSRVETYGYNKEGQKAFSYKMYHEGDKPTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 152 - protein, 261 aa, Artificial Sequence
  Synthetic:  Ww55 phage
MAISSGWVGSSAVSETGQRWMSAAMQAVRLGRPAYMSAMVGRSKEIHYSIGASNSYNKDTLINWMKAQGSTPVVITITGNIVSQSTGVPCLDFPSSLTNEYVTLIINSGVHVLGRGGNGGSNSAGGAGGNAINNGIGTRLRINNNGIIGGGGGGGAGARYNPFPQMDMKFGGGGGRPFGAAGAAGGGAAAASAGTISAPGKGTVSGVHYGGDGGDLGAAGKSSYIKGGTGGTVHSGGAAGKAVTGNAPRWDKVGTIYGARV

SEQ ID NO: 153 - protein, 86 aa, Artificial Sequence
  Synthetic:  Ww55 phage
MSNQHEQMINVLKVRLFDTQEKAAFLEGQLKDRERVLMELVRILGIQPDENGTVSLDAIVEEVKALLPKDEAAEDAEEEVELITEA

SEQ ID NO: 154 - protein, 1217 aa, Artificial sequence
  Synthetic: WW34 3.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRTPGELNVYSKQEIDRMFVKNVKMSTPSGEATRGYFKIASAMIPQSGRMAFLRIYGGNGFNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSAIPGSYKGYVITGKMELHGSGNSMILHRQTAQAAYMSWWDRRDGKNQRSGYIGHADGTSDAIVWNNDIGQNSAVLETSGQISFRTGATKIVYTNGQYYSANSDAYRMIFGNYGAFWRNDGTKVYLLSTAENDKYGGWNAYRPFIYDLTSGNVQLGGDGNEDALTLECASRAARFSNDVYIKKGLLTFDAGRAGSRDYIRFNHWGDSNNARDNVLCIEDSQGRHFSTERAMGTGALKAYFLGDLEVGGKFTWGKNTATSSFNIRAWGNDSRKQVLECADESGWHWYTQRTGGPDTSAIDFAINGTVRPQAIHTGGNITINGADIEFKRTGNKHIWFRDPNGLELGLMYCDDAGAIRFRGQKQAQAWKFADKMIQLESGTVSGGGNGLIRGEVAGGSWASWRDRAAGLMVGCPQSTNSAHNVWKATHWGKYHIAAMAVHVPDGTITNALARLNVHDANFDFSASGDLSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 155 - protein, 259 aa, Artificial Sequence
  Synthetic:  Ww34 phage
MAISSGWVGSSAVSETGQRWMSAAMQAVRLGRPAYMSAMVGRSKEIHYSIGASNSYNKDTLINWMKAQGSTPVVITITGNIVSQSTGVPCLDFPSSLTNEYVTLIINPGVHVWGRGGNGGNNSAGGAGGNAINNGIGTRLRITNNGAICGGGGGGGGGYYSPFSQMRLTFGGGGGRPFGAAGGSANMEQGATAGTISAPGKGSVNGVYNGGNGGDAGGAGGKCNIRGQGSEYNGGAAGKAVTGNAPRWDKVGTIYGARV

SEQ ID NO: 156 - protein, 86 aa, Artificial Sequence; identical to SEQ ID NO: 153
  Synthetic:  Ww34 phage

SEQ ID NO: 157 - protein, 1651 aa, Artificial sequence
  Synthetic: WW14-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRNQIIDLGFAKGGQVDGDVTINGTLNLNGPEIVASGGYIEFNYRTTGSGSWAGQHAAKAPIFVDLSAALSTSEYNPLFKQRYKDGTFSAGTLVTEGSFKFHYINEAGDSKYWTFNRNGNFQVDTGSLFVSGGNISASGNINSASGFVSAPQINTKNIILDTKAFGQYDSQSLVNYVYPGTGETNGVNYLRKVRAKSGGTMWHELCTAQLGQADEMSWWTGNTPQSKQYGVRNDGRLIGRNSLALGTMTTDFPSSDYGNTGAMGDKYLVLGDTATGLKYIKQGNFDLVGGGYSVASITTDGFRGTSKTLFGRSNDQGLTWLLPGQNSAMVSIRTEIDGNNSGDGQTHLGYNSNGKLYHYFRGTGRVAISMAEGMIIEPGILNIKTGVNELNLRADGTVSTTQRLMVNNGLVLNANNNTSALALTAPTGVDGTKTINWDAGTRNGQNKNTVTMKAWGNSFNAGGGNRETVFEVSDSQGYYFYGQRTNPASGETVGPINFKFNGSVETGHFSSLGNISASGTGSFGGNVTMTNGLFVQGGASINGQVKMGGTADALRIWNAEYGMIFRRSETGSSASFHLIPTLQNAGENGGISDLRPLSINLASGTVIMGNKSTGGPLFTVDNVSKFVQTDCRLRVNMDSDGIVLNASSQAASNFIQGRKADVTKWYLGIGDGGNVVRMHNYTYSHGIALNSDTVDITKPLKIGSDIRIGTDGNIIGSATLDNFKNLNTTLDHKVNMGGWSGGATTGWYKFATVEIPQATGTASFKIFGGSGFNFKSYGQASIAEIILRTGNNNPKGLNATLWNRTSEAISQIASVNTSEDIYDIYVYLGGYSNSLVVEYTCSSNSKVTVVGMDGGVQPLVETLPEGHVVGKSVRMLNNLDGMFAAGESDIVTRGEYVTNNQKGMRIKSKGNDLDSNAALLRNDGGSFYILATDKNTTEKPDAANGDWNGLRPFSINMADGRVGMNHGLNITGGGLNVTGGNTNLGNITSRVVSSARAGSGWGDNSDAMKSKITFMADHGDLSNSGSYYPIVGAYSNYGSAGYRQTFEFGWVGSGSTANWREGIIRIRGDNANGQQARWRFTMDGILGCPGKVEMPETSAFGINTTNGFGGNSIVIGDSDTGFRQVGDGLLEVWTNASRRMRFQGGDTYSDMNINAPNVYIRSDIRLKSNFKPIENALDKVEQLDGLIYDKADYIGGEVVHTEAGVIAQSLEKVLPEAVREVDDIKGNKVLTVSTQAQVALLIEAVKTLSAKVKELEAKLN

SEQ ID NO: 158 - protein, 262 aa, Artificial Sequence
  Synthetic:  Ww14 phage
MAIVGVPGWIGQSAVDETGQRWMDAAMRDVRVAVPGWMGSMAGQSKEIYLSIGANNSYDRNSLINWMRAQGGAPVVITITGNLVSNSTGNACLEFPSNLPNAYIQLIINSGVTVYGRGGNGSTNGSAGGNGGTAIHNAAGTKLRIRNNGAIAGGGGGGGAVSLQNSYPTNGTCGGGGGRPFGVGGKIGSDAILSGSNASLTAAGTGGATVQYGGGNGGNVGAGGGRGWGKNVYTSAGGSAGAAVTGNAPNWQNVGTIYGSRV

SEQ ID NO: 159 - protein, 76 aa, Artificial Sequence
  Synthetic:  Ww14 phage
MSEQTIEQKLQAEIVALKSRILDTQDVAAQAQQESRILQDALSKIAARLGITGDQIQIEDLIAAVPDLTAESADEE

SEQ ID NO: 160 - protein, 1325 aa, Artificial sequence
  Synthetic: WW170-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGAIINLSCPPVYDRDVTMAGKVKGNNYILSKTANYLEDQTARDLNYFGAFRTNGQDGLLDLTLNVPHSAGVNHGRGFTFRYATGGSRVETYGYNAQGQKAFSYKMYHEGDKPTPSELNVYSKQEVDRMFVKTVKLATVPVDIVDGYFKLATAMIPQNGRSVFFRIHGGNGYNVTAYDQVDIVEIVIRSGNNRPKGVNVIAYRRNTNKAFDVLAVNTSGDNYDIYVKYQRYTDNVIVEFGKSVDVDLVVHDVPDFVVDRPVGDNVIGGRAVTLFNTENKRGVLSFDDNTQNSYDIVHLSNDRGTGRKYIRKFRSNYNEMIWHETVQGSTYRLATGSTDAQEILSVESSSSIAGTHKGNILSGRMMLGGGSNVITLRRPAGQSNHIAFQDNRTGSITRQGWIGYGNADTNVFEWYSDVGGTSIRHHIDGQIELATGNTKRVYTNAQFISMNSDAYRMIFGNYGAFWRNDGTKVYLLSTAEDDKFGGWNGNRPFIYDLTNGKVTLGGDGNEGALVLERDSRAARFAGDVYVEKGFLHFSSGRQGASGFMKINHLGDIASGRHNILQIEDPTGIHFSTERNDETGNITARFKGFVRVEAGEIAFDANRGSQSQFTLHTWGNEQRKQVFECKDATGYHWYTERTQGGTGNVLFSMAGSLNVTSNITTTGADITFKRAGNKHIWFRDPDGLELGLMYCDDAGAIRFRGQKQAQAWKFADKMIQLESGTVSGGGNGLIRGEVAGGSWSSWRDRAAGLMVGCPQSTNSAHNVWKATHWGKYHIAAMGIHVPDGTIGNALARLHVHDTNFDFSASGDMTAGRNGSFNDVYIRSDARLKINKEEYKENATDKINRLTVYTYDKVKSLTDRTVIAHEVGIIAQDLEKELPEAVTTSKVGDPDKPEEILTISNSAVNALLIKAFQEMSEELKAVKAELAELKKN

SEQ ID NO: 161 - protein, 259 aa, Artificial Sequence; identical to SEQ ID NO: 155
  Synthetic:  Ww170 phage

SEQ ID NO: 162 - protein, 86 aa, Artificial Sequence
  Synthetic:  Ww170 phage
MSNQHEQMINVLKVRLFDTQEKAAFLEGQLKDRERVLMELVRILGIQPDENGTVSLDAIVEEVKALLPKDEAAEDAKEEVELITEA

SEQ ID NO: 163 - protein, 1315 aa, Artificial sequence
  Synthetic: WW202-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGQIVNLSCPPVYDKGFDVRGRVVVDDLVWSNTANYFDDPTARNLDKFGAFRTNDMDGHLAFALHIPHPSGINHARGFDFTYGSNVVPTVKTYGYNADGVLAYSYRMYHEGDKPSPSELNVYSKQEVDRMFQKTINFGVETGWFKIATAFIPQNDGRSLKIRLVGGNGWNVGQTGQCNIIELVIRTSNGSPKGINFVAYHHVSGYENQFCAINTGDDTYDIYAYYYEFTNMVMAEYQASSDVNLTVFDRPEYVGEKPVAEHIFDAYTIHSFNSFSNRGTLNFAGNHQGQYDIEHMNEQPTNAKKMLRRFRSSASATIWHETVDDQNYRLATGGTDSVQQLLLSSGTGLHIRRLTIDGGLGSGSNAGIDIRRGPNESSHFNFMDYRTGQDVRNGWFGFGDLTTKDFIWWNDNGQNSINLIENGELHITGGRGQKIVMNSEVALSENARLAVKGGNYGLILRNDGTGFHILTTDLKDSFGSWNNRRPFSYNFADGGLYLGGTETARCLHLGIDGSTRLEDNLFFKAGSRQSMDYMELVHWGASNTGRNNVLSLRDSKGFLAEFERVGGTDGVKTRFFGETFTDGTLYLNQMNNSSERFSINNWGNSEVGRAAVMEVGDSKGYHFYAERRTDDTVLFDVSGALTVHGPNGITVKNSTGARHIWFRDDSDTEKAVIWATDDGMLHIRNNHEGSFAHHFQGAMIKLEGRVPYGAAKGLIRGEVDGGAYVAWRDRPAGLLVDCQKSIDSAHAVWKAVDWGRQYIAAMDVHCPGDGNNTAAAVLHVQAADYQFHASGEFHASGNGNFNDVYIRSDRRLKDNIEDYTGNALSLIGKLKVKTYDKVKSLKDREIIGHEIGIIAQDLQEILPEAVKSSKVGNLDNPDDVLTISNSAVNALLIKAIQEMSEEIKELKTPFFTKIARKISKYFKF

SEQ ID NO: 164 - protein, 260 aa, Artificial Sequence
  Synthetic:  Ww202 phage
MAVVGVPGWIGSSAANETGQRWMSQAAGQLRLGVPCWMSQFSGRSREIIHTLGADHNFNGQWFRDRCFEAGSTPIVFNITGDLVSYSKDVPLFFMYGDTPNEYVQLNIHGVTMYGRGGNGGSNSPGSAGGHCIQNDIGGRLRINNGGAIAGGGGGGGGGYYSPFSQMRLTFGGGGGRPFGAPGGSIDMQSGATAGTLYAPGSGSVNGIYNGGSGGEVGAAGGRCNIRGQGYEYNGGDAGYAVIGSSPTWQNRGAIYGPAV

SEQ ID NO: 165 - protein, 86 aa, Artificial Sequence
  Synthetic:  Ww202 phage
MSNQHEQMINVLKVRLFDTQEKAAFLEGQLKDRERVLMELVRVLGIQPDENGTVSLDAIVEEVKALLPKDEAAEDAKEEVELITEA

SEQ ID NO: 166 - DNA, 2706 bp, Artificial sequence; identical to SEQ ID NO: 116
  Synthetic: WW13 13.0

SEQ ID NO: 167 - DNA, 2940 bp, Artificial sequence
  Synthetic: WW13 10.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 168 - DNA, 4299 bp, Artificial sequence
  Synthetic: WW13-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggaaatattattgatctgggttttgctaaaggcggtagtattgacggaaatgttattcatataggaaattataatcaaactggtgattatactttaaatggcaccttcactcagacaggtaattttaatttaactggtattgctcgagtaactcgcgatattattgccgccgggcaaattatgactgagggcggagaacttattacaaaaagttcaggtacagcacatgttcgttttttcgatggcaatagccgcgaacgtggaatcatttatgccccggccaatgatggtttaactacgcaagttcttaatatcagggttcaagactacgccgctggtagcgaaagcacttatgcattttcaggcagtggcctatttacttcacctgaagtatcggcatggaaatctatgtcaactcctcagattttgaccgataaagttattacaaatgggaagaagacaggcgattatgatatctattcattatcaaataacactccattggcagaaagcgaaacggctattaaccacctccgtgttatgcgaaatgctgtaggagcaggtattttccacgaagttaatgttaatgacggaataacctggtattccggagatggcttagacacttatctttggtcgtttaactgggccggtggattgaaagctggtcattctatttctgtaggtcttccgggtggctctaaaggatattctgaattaggaacggcctcaattgctcttggtgataatgacaccggatttaaatggcatcaggacggatattttcatacagtaaacaatggaacaagaactttcatctacggccctgcggaaacacaaagccttagaaaaatggttatgggttattctccggacgggattcttatgacaacgccaccgacagaaaactatgctcttgctactgtagtgacataccacgataataacgcgtttggagatggtcaaactcttttaggatattatcaaggcggtaactatcatcactatttccgcggtaagggtactacaaacattaatactcatggcggtttgttagttactccaggcaatattgacgttattggtggttctgttaatatcgatggtagaaataataattcaactttaatgtttaaaggctataccatgggtcaaagctccgttgataacatgtatatagctgtttggggaaatacatttactaatcctagtgaaggcacccgtaaaaatgtcatggaaatttctgatgatattggatggatgcattatattcaacgaaataaagataatacagttgaagccgtattaaatggtcaacagacaattaacgaaaatattattgcgaaaaaggatatttgggttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 169 - DNA, 780 bp, Artificial Sequence; identical to SEQ ID NO: 117
  Synthetic:  Ww13 phage

SEQ ID NO: 170 - DNA, 243 bp, Artificial Sequence; identical to SEQ ID NO: 118
  Synthetic:  Ww13 phage

SEQ ID NO: 171 - DNA, 2796 bp, Artificial sequence
  Synthetic: PP-1
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcgctacccgcgtgtccaaagaaggtgacactatgactggtaagctgactctgtctgcgggtaacgatgcgctggtgctgactgcgggcgagggcgcgtcctcgcacattcgctctgacgtgggcgggacgaacaactggtatatcggtaaaggcagtggggataacggtttaggcttctactcatacatcactcagggcggggtgtatattaccaacaacggggaaatcgctttaagcccgcagggtcagggtacgtttaacttcaaccgtgatcgtctgcacatcaacggcacgcaatggacggcacatcaaggcggtggctgggaaaaccagtggaatcaggaagcgccgatttttattgatttcggcaacgtgggcaatgatagctactacccgattatcaaaggtaagtccggcattaccaacgaaggttatatttctggcgtggacttcggtatgcgtcggattactaacacgtgggcgcagggtattatccgcgtaggcaatcaggaaaacggtagcgatccgcaggccatctacgagttccatcataatggcgtactgtacgttcctaatatggtaaaaacgggtgcgcgtctgagcgcaggtgggggggatccggtatggcagggtgcatgtgttgttatcggtgacaatgacacgggcttagtgcatggtggcgatggtcgcatcaatatggttgcaaacggtatgcacattgcgtcttggagttccgcgtatcatttacatgagggtttatgggatactacgggcgcgttatggacggagcaagggcgtgcaattatcagcttcggtcatctggtacaacaaagcgatgcctattccacctttgtccgtgatgtatacgttcgttcggatattcgcgttaaaaaagatctggtgaaattcgaaaacgctagcgaaaaactgtccaaaatcaacggttatacttatatgcagaaacgcgggttagacgaagaaggtaatcagaaatgggagcctaacgccggattaatcgcgcaggaagtgcaggcgattctgccggaactggtagaaggcgatccggacggtgaagcattattacgtctgaactacaatggcgtgatcggcctgaatactgcggcgattaatgaacatacggcagagatcgcggagctgaaaagcgagattgaagaactgaaaaaaattgtcaaaagcctgttaaagtaa

SEQ ID NO: 172 - DNA, 780 bp, Artificial Sequence; identical to SEQ ID NO: 114
  Synthetic:  pp-1 phage

SEQ ID NO: 173 - DNA, 243 bp, Artificial Sequence; identical to SEQ ID NO: 115
  Synthetic:  pp-1 phage

SEQ ID NO: 174 - DNA, 3654 bp, Artificial sequence
  Synthetic: WW55 3.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtactccaggagaattgaacgtctatagcaaacaagaaattgaccgtatgtttgttaagaacgttaaaatggttgttccttctggtggtgcaacccgtggttattttaaaattgcatccgcaatgatcccgcagagtggtcggatggcgtttctgcgaatctatggtggtaatggatataatgtaaactcatatgatcaagttgattttcttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgacgtcgcattgactgttcatgatgttcctgaattttcggcgactaaaccagaaaccggaactaaatttgatgctcgtgttattacgatgttcaacaccgaaaacaaagccggaacattgatgtttgataataacaatcagttaacctatgatattgttagccttagcaatggtcctgatgatgttagaaattatctgcgtaaattccgaagtaaagcgggtgaaatgatttggcatgaaaccgttcagggtgctgtatatcgtcttgctactggaactactgattctacggaagttcttagagttgattctaacagtgctctcccgggtagctataaaggatatgtaattactggtaaaatggaattgcacggtagcggtagtgcgatgaatttacaccgccagactggtcaagctgcatatatggcgtggtgggatcgtcgtgatggtaaaaaccaacgtagcggttatatcggtcatgcggatggtactactgatggttttgtgtggcgtaatgatgttggtgcgaactcatttgatttggaaagtagtggacaagtaaatttgactacaggaaaaacaaaaattgtatataccaacggacaatattattccgctaactctgatgcattccgtatgatttacggcaattatggcgcattctggcgaaatgatggtggtaaagtttatctgttgtctactgccgaaaatgatagatttggtggatggaacggcaaccgaccattcatttacgacctgtcaactggtaaagttactttaggtggcgacggtaacgaaggcgcattagttctcgaaagagatagccgtgcggctagatttagcaacagcgtattcttagaaaaaggattgcttactttctctgcgggtgggaatcagtcaatggattctttcacgattaaccattgggggaatagtaacgctggacgatataatgttttacaatttgaagacacgaaaggaacacattttacaaccgaacgtaatgctgatggtggattgcttgctcacttccgaggggatttaaccacagaagggaaattaacgtggggtaagggtacagccacatctagctttaacattcgtgcatggggtaatagtgattcccgtaaacaggttttcgagtgtgtagatgaaagtggttggcattggtatacccagcgaccgggcggtcctggtacttctgcaattgagtttgccatcaatggtactgttaagcctcaagcaattcacactggcggtaatattcttttgaacggtgctgatattgagtttcgtcgcactggtaataagcatttgtggtttagagatccaaacggattagaattgggtttgatttattgtgatgacaacggtgtcattcgttttcgtggtcagaaacaaggtcaagattgggtatttgccaataagatgatccaattagggaccgcttctactgttggtggatctggtaacggtttgattcgcggacaagttcaaggtggtgcttgggcacaatggagagaccgtgctgctggaatccttgtagactgtcagcaatctactgattccgctcataacatctggaaagcgactcattggggaaaatatcatattgcggcaatgggtgtacacgttcctagcggcactataggtaatgctatggcacgtctaaacgtaaatgacgccaactttgactttagcgcctccggtgacatgtcggcagggcgtaacggttcgtttaacgatgtttatattcgttctgatgctcgccttaaaatcaataaggaagagtataaagagaatgccaccgataaagttaatcgcttaactgtatacacctatgacaaggttaaatctttaaccgaccgtactgtcattgctcatgaagttggcattatcgcacaggatcttgagaaagaattgccggaagcagtaacaacctcgaagatcggcgatccagataaaccagaagagatcttaacaatttctaactctgctgtcaacgctcttttaattaaggcgtttcaggaaatgagcgaagaattgaaagccgttaaagctgaactagcggaacttaaaaagtaa

SEQ ID NO: 175 - DNA, 3993 bp, Artificial sequence
  Synthetic: WW55-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggtgctattatcaatttaagttgtcctcctgtttatgaccgcgatgttacaatggcgggtaaggttaaaggtaataattatatcttaagtaaaaccgctaactatctggaagatcagacagcgagagatcttaactactttggcgctttccgtaccaatggtcttgatggtcttctcgaactcacgctaaacgttcctcactcttccggtgtccaacatggtcgaggatttactttccagtatgggcacactggatcgcgtgtagaaacttatggctataataaagaaggtcaaaaagcatttagttataaaatgtatcacgaaggtgataaaccaactccaggagaattgaacgtctatagcaaacaagaaattgaccgtatgtttgttaagaacgttaaaatggttgttccttctggtggtgcaacccgtggttattttaaaattgcatccgcaatgatcccgcagagtggtcggatggcgtttctgcgaatctatggtggtaatggatataatgtaaactcatatgatcaagttgattttcttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgacgtcgcattgactgttcatgatgttcctgaattttcggcgactaaaccagaaaccggaactaaatttgatgctcgtgttattacgatgttcaacaccgaaaacaaagccggaacattgatgtttgataataacaatcagttaacctatgatattgttagccttagcaatggtcctgatgatgttagaaattatctgcgtaaattccgaagtaaagcgggtgaaatgatttggcatgaaaccgttcagggtgctgtatatcgtcttgctactggaactactgattctacggaagttcttagagttgattctaacagtgctctcccgggtagctataaaggatatgtaattactggtaaaatggaattgcacggtagcggtagtgcgatgaatttacaccgccagactggtcaagctgcatatatggcgtggtgggatcgtcgtgatggtaaaaaccaacgtagcggttatatcggtcatgcggatggtactactgatggttttgtgtggcgtaatgatgttggtgcgaactcatttgatttggaaagtagtggacaagtaaatttgactacaggaaaaacaaaaattgtatataccaacggacaatattattccgctaactctgatgcattccgtatgatttacggcaattatggcgcattctggcgaaatgatggtggtaaagtttatctgttgtctactgccgaaaatgatagatttggtggatggaacggcaaccgaccattcatttacgacctgtcaactggtaaagttactttaggtggcgacggtaacgaaggcgcattagttctcgaaagagatagccgtgcggctagatttagcaacagcgtattcttagaaaaaggattgcttactttctctgcgggtgggaatcagtcaatggattctttcacgattaaccattgggggaatagtaacgctggacgatataatgttttacaatttgaagacacgaaaggaacacattttacaaccgaacgtaatgctgatggtggattgcttgctcacttccgaggggatttaaccacagaagggaaattaacgtggggtaagggtacagccacatctagctttaacattcgtgcatggggtaatagtgattcccgtaaacaggttttcgagtgtgtagatgaaagtggttggcattggtatacccagcgaccgggcggtcctggtacttctgcaattgagtttgccatcaatggtactgttaagcctcaagcaattcacactggcggtaatattcttttgaacggtgctgatattgagtttcgtcgcactggtaataagcatttgtggtttagagatccaaacggattagaattgggtttgatttattgtgatgacaacggtgtcattcgttttcgtggtcagaaacaaggtcaagattgggtatttgccaataagatgatccaattagggaccgcttctactgttggtggatctggtaacggtttgattcgcggacaagttcaaggtggtgcttgggcacaatggagagaccgtgctgctggaatccttgtagactgtcagcaatctactgattccgctcataacatctggaaagcgactcattggggaaaatatcatattgcggcaatgggtgtacacgttcctagcggcactataggtaatgctatggcacgtctaaacgtaaatgacgccaactttgactttagcgcctccggtgacatgtcggcagggcgtaacggttcgtttaacgatgtttatattcgttctgatgctcgccttaaaatcaataaggaagagtataaagagaatgccaccgataaagttaatcgcttaactgtatacacctatgacaaggttaaatctttaaccgaccgtactgtcattgctcatgaagttggcattatcgcacaggatcttgagaaagaattgccggaagcagtaacaacctcgaagatcggcgatccagataaaccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 176 - DNA, 783 bp, Artificial Sequence
  Synthetic:  Ww55 phage
atggcaatatcttctggatgggtaggatcatctgctgtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacaaggatctactccggtagtaattactatcacgggtaatattgtttcccaatctactggcgttccttgtcttgatttccctagctcactgacaaacgaatatgtaacactcattattaactctggtgttcatgtattaggtcgtggaggaaatggcggaagtaactctgctggtggagcaggaggaaatgcaataaataacggaattggaactcgtttaagaataaacaataatggtattattggtggtggcggtggtggcggtgctggtgctagatacaatcctttccctcaaatggatatgaaatttggcggcggtggaggccgtccatttggtgctgcgggtgcggcaggaggcggcgcagcggcagcatctgctggtacaatttctgccccaggtaaaggcactgtttctggggttcattatggaggagatggtggagatttgggagctgctggcaaatcttcatatattaaaggtggtactggtggaactgttcactcgggtggtgctgcgggtaaagctgttactggtaatgcccctcgctgggataaagtaggcacgatctacggtgctcgcgtg

SEQ ID NO: 177 - DNA, 261 bp, Artificial Sequence
  Synthetic:  Ww55 phage
atgtccaatcagcatgaacaaatgattaatgtcctgaaagtacgtctgtttgacactcaagaaaaggccgcattcttagaaggccaactgaaagatcgtgagcgtgtattgatggaactggtacgcattctgggtattcagccagacgaaaacggcactgtttcccttgatgctattgtcgaagaagtgaaagcacttctccctaaagacgaagcagcggaagacgcagaagaggaagtagaactgatcacggaggcttga

SEQ ID NO: 178 - DNA, 3654 bp, Artificial sequence
  Synthetic: WW34 3.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtactccaggagaattgaacgtctatagcaaacaagaaattgaccgtatgtttgttaagaacgttaaaatgtctactccttctggtgaagcaacccgtggttattttaaaattgcatccgcaatgatcccgcagagtggtcggatggcgtttctgcgaatctatggtgggaacggatttaatgttaactcctacgatcaggtggatttccttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgatgttgcattgactgttcacgatgttcctgaattttcggcgactaaaccagaaaccggaactaaatttgatgctcgtgttattacgatgttcaacaccgaaaacaaagccggaacgttgatgtttgataataacaatcagttaacctatgatattgttagccttagcaatggtcctgatgatgttagaaattatctgcgtaaattccgaagtaaagcgggtgaaatgatttggcatgaaacagttcagggtgctgtatatcgtcttgctactggaactactgattctacggaagttcttagagttgattctaatagtgctataccaggtagctataaaggatatgtaattactggtaaaatggaattgcatggtagtggtaattcgatgattttacatcgccagactgctcaagccgcgtacatgtcgtggtgggatcgtcgtgatggcaaaaaccaacgtagcggttatatcggtcatgcagatgggactagtgatgctattgtgtggaataatgatattggacaaaacagtgctgttctagaaacatctggtcaaatatctttcagaacaggtgcaaccaaaattgtatataccaacggacaatattattccgctaactctgatgcataccgtatgatctttggtaattacggtgcattctggcgtaatgacggcactaaagtttatcttctttctactgctgaaaatgataagtatggtggatggaatgcctatcgtccattcatttatgatttaacttccggtaacgttcaattaggcggtgatggtaacgaagatgcattaacgttagaatgtgcttctcgtgccgctcgctttagtaatgacgtttacattaagaaagggcttttgactttcgacgctgggcgcgctggatctcgcgattatattcgatttaatcattggggtgatagtaataatgcccgtgataacgttttgtgcatagaagatagtcaaggccgacattttagcacagaacgtgcgatgggtactggtgctcttaaagcatacttcttaggcgatcttgaagtcggtggtaagtttacttggggtaaaaatacagctacatctagctttaatattcgtgcatggggtaatgattcccgtaaacaagtattagaatgcgcggatgaaagtgggtggcattggtacacacaacgaacgggcggtcctgatacttctgcaattgattttgccatcaatggtactgttaggcctcaagcaattcacactggcggtaatatcactatcaacggtgctgatattgagtttaaacgcactggcaataagcacatctggtttagagatccgaacggtttagagttaggcttgatgtactgcgatgatgctggtgctattcgcttccgtggtcagaaacaagcccaggcgtggaaatttgcagataaaatgatccagttggaatctggcactgtatccggtggcggtaatggcctgattcgtggtgaagttgctggcggtagttgggctagctggcgtgaccgtgctgctggtcttatggttgggtgtcctcaatccaccaactcggcacataacgtatggaaagcgacgcattggggtaaatatcacattgcagcaatggctgtacatgttcctgatggtactattaccaatgctttagctcgcctaaacgttcatgacgccaactttgactttagcgcctccggtgacctgtcggcagggcgtaatggttcgtttaacgatgtttatattcgttctgatgctcgccttaaaatcaacaaggaagagtataaggagaatgccaccgataaagttaatcgcttgacggtatacacctatgacaaggttaaatctttaaccgaccgtactgtcattgctcatgaagttggtattattgctcaggatcttgagaaagaattgccggaagcagtaacaacttctaagatcggcgatcctgataagccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 179 - DNA, 777 bp, Artificial Sequence
  Synthetic:  Ww34 phage
atggcaatatcttctggatgggtaggatcatctgcggtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacagggatctactccggtagtaattactatcacgggtaatattgtttcccaatctactggagttccttgtcttgacttccctagctcgttaacaaacgaatatgtaacattgatcattaacccaggtgttcatgtttgggggcgtggtggtaatggtggcaataactccgctggtggcgctggtggtaatgcaattaacaacggtataggcacacgcttacgcatcacaaataacggcgctatttgcggtggtggcggcggcggcggcggcgggtattattctcctttttcacaaatgagattaacctttggtggtggcggtgggcgtccgtttggtgctgccggtgggtctgctaatatggaacagggtgctactgctggtactatttccgcgccaggtaaagggtctgtaaacggtgtatataatggcggtaacggtggtgatgctggtggtgctggtggtaaatgtaatatccgtggacagggatcggaatataacggtggtgcggctggtaaggctgttactggcaatgcccctcgctgggataaagtaggcacgatctacggtgctcgcgtg

SEQ ID NO: 180 - DNA, 261 bp, Artificial Sequence; identical to SEQ ID NO: 177
  Synthetic:  Ww34 phage

SEQ ID NO: 181 - DNA, 4956 bp, Artificial sequence
  Synthetic: WW14-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaccagattattgatttaggctttgcaaagggtggacaagttgacggtgatgtaactattaacggaactctgaatttaaacggccctgaaattgttgcctccggtggttatatagaatttaactatcgtacgacaggtagtggctcttgggcgggtcagcacgcggccaaagctcctatttttgttgatttaagtgcggcgttatctacttcagaatacaacccactgtttaagcagcgttacaaagatggaacattttcagcaggtacattagttactgaaggtagttttaaatttcactatattaatgaagctggtgattcgaaatattggacctttaatcgtaatggtaattttcaagttgataccggtagtttatttgtatcgggtggtaatatttccgcttcaggcaatatcaactctgcctcagggtttgtgtctgcgcctcagattaatactaaaaatattattttagatacaaaagcatttggacaatacgacagtcagtctttagttaattacgtatacccaggcaccggcgaaacaaatggtgtaaactatcttcgtaaagttcgtgctaaatccggcggcactatgtggcatgagctttgcactgcccaattaggccaagccgatgaaatgtcttggtggacaggtaatacccctcagtctaaacaatacggtgttcgtaacgacggccgtttgattggtagaaatagccttgcattaggtactatgactaccgatttcccatctagcgattatggtaataccggagctatgggtgacaaatacctagttttaggtgatactgcaaccggtttaaaatatatcaaacaaggcaattttgatttagttggtggtggatattctgttgcgtcaattaccacagacggtttccgtggcacaagtaaaaccttatttggtcgtagtaatgaccaaggtttaacatggcttcttcctggtcaaaactctgcaatggtttctatcagaaccgaaatagatggtaataactctggcgatggccaaacccatttaggttataattctaatggtaaactttatcattatttccgtggtaccggtcgtgtagccatttctatggcagaaggtatgattattgaacctggtattttaaatattaagaccggggttaacgaattaaatcttagagcagacggcacagtttctactacacagcgtttaatggttaataacggcttagttcttaacgcaaacaataatacttctgcattggcattaactgctcctaccggtgttgatggtacaaaaaccattaactgggacgctggtacccgaaatggccagaacaaaaataccgttaccatgaaagcatggggtaactcatttaacgcgggtggtggtaatagagaaactgtattcgaagtatcagattcacaaggatattatttctatggccaacgtactaatccggcttccggtgaaactgtaggccctattaacttcaagttcaacggttctgttgaaacaggtcatttttctagtctcggaaatataagtgcatctggtaccggttcttttggtggcaatgttaccatgactaatggcctgtttgtccaaggcggcgcttcaattaatggccaagttaaaatgggtggtactgctgacgcattaagaatttggaacgctgaatatggtatgattttccgtcgttcagaaacgggttcttctgcttcattccatcttattcctacccttcaaaacgccggtgaaaatggcggaataagtgaccttcgtccactatctatcaatttagctagcggcacggttataatgggtaataaaagcacaggtggcccacttttcacagtagacaacgtaagtaaatttgttcaaaccgactgtagattgcgtgttaatatggattctgatggtattgttttgaatgcttcatctcaagcagcatccaactttattcaaggacgtaaagcagatgttacaaaatggtatctaggtattggcgatggtggcaacgtcgttcgtatgcacaactatacttattcacatggtattgcattaaactctgataccgttgatataaccaagcctcttaaaataggttctgatattcgtatcggtactgatgggaatattataggcagtgctactttagataactttaaaaacctgaatacaacattagaccataaagttaatatgggcggttggtccggcggtgctactacaggttggtataaatttgctactgtagaaattccacaggcaacaggcacggcatcttttaaaatatttggcggttccgggtttaattttaaaagttacggtcaggcttcaatagctgaaataattcttagaaccggtaataataaccctaaaggccttaatgccacgttgtggaataggacttctgaagctatttcccagattgcttcggttaatacaagcgaagatatctatgatatttacgtttacttaggtgggtattctaattctttggtggtagaatatacctgcagcagcaatagtaaagtaaccgtagtaggtatggatggtggtgtccagcctttggtagaaacattacctgaaggtcatgttgtaggtaaatctgtaagaatgctgaacaaccttgacggaatgtttgccgctggcgaatcggatattgttactcgtggtgaatatgttaccaataaccaaaaaggtatgcgtattaaatctaaaggtaatgatttagattctaatgctgctttacttagaaacgacggtggaagtttttatattttagctacagataaaaatacgacagaaaaacccgatgcggctaatggtgattggaatggcttaagacctttctcgattaatatggctgatggtcgcgttggtatgaaccacggattgaatattactggcggtggtctgaacgttaccggcggtaatactaaccttggtaatattacatctcgtgtagtttcttcggcacgcgccgggtccggttggggtgataactctgatgctatgaaatccaaaattacctttatggctgaccacggtgatttatctaattcaggcagttattatcctatcgtaggcgcatacagcaactatggttcagcgggttatcgtcaaacctttgaatttggatgggtcggctctggtagcaccgcaaattggcgagaaggtattattcgtattcgcggtgataatgctaacggccagcaagcaagatggcgctttacaatggacggtattttaggttgccctggtaaagtagagatgccagaaacaagcgcatttggtatcaacacaacaaatggatttggtggtaactcgattgtaattggtgatagcgatactggttttagacaagtcggtgatgggcttttagaagtttggactaacgcctcacgccgaatgagattccaaggcggtgatacctattcagatatgaatattaacgccccgaacgtttatattcgttctgatattcgtttgaaatctaacttcaaaccgattgaaaatgctcttgataaggttgaacagctagacggtttaatctatgataaagctgattatattggcggcgaagttgttcataccgaggccggtgttattgctcagagtttggaaaaagtattgcctgaagctgtccgtgaagttgacgacattaaaggtaacaaagttcttaccgtttcaacccaggcacaagttgctctgttaattgaagcagttaaaactctgtcggctaaagttaaagaacttgaagcaaaacttaattaa

SEQ ID NO: 182 - DNA, 789 bp, Artificial Sequence
  Synthetic:  Ww14 phage
atggcaattgtaggtgttcctggttggattggacaatctgccgtagatgaaacgggacaacgttggatggatgccgctatgcgcgatgtgcgagttgcagtacccggttggatggggtcgatggcaggacaatcaaaagaaatttatctatctataggggctaataactcttatgatagaaactcccttattaactggatgagggctcaaggtggcgcgcctgtagttattacaatcaccggtaacttagtatccaatagcaccggtaacgcttgtttggaatttcctagcaatcttcctaacgcgtatattcaacttatcattaatagcggtgtgactgtttatggccgaggaggtaatggttctactaatggttcggcaggtggaaacggtggtacagctatccataacgcagccggaactaaactccgtattcgtaataacggcgctattgccggtggtggtggtggcggtggcgcagtatcattgcaaaatagctacccgactaatggtacatgcggtggtggtggtggtagaccatttggcgtaggtggtaaaataggctctgacgctatattgtccggttcgaatgcgtctttaacagctgccggtacaggtggtgctacagtccaatatggtggaggtaatggcggtaacgttggagctggcggtggacgaggatggggcaaaaatgtttatacctctgcaggtggctcagctggtgctgctgtcactggcaatgctcctaactggcaaaacgtaggaactatttacggctcaagagtctag

SEQ ID NO: 183 - DNA, 231 bp, Artificial Sequence
  Synthetic:  Ww14 phage
atgtctgaacaaactattgaacaaaaactgcaagccgaaatcgtagctcttaaatcccgcattctggacacccaggatgttgcagctcaagctcaacaggaatcacgtattctgcaggatgcgctgagtaaaatcgctgctcgcttaggcatcaccggtgaccagattcagattgaagacctgattgccgctgttcctgatttgaccgctgaaagtgctgacgaagaataa

SEQ ID NO: 184 - DNA, 3978 bp, Artificial sequence
  Synthetic: WW170-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggtgctattatcaatttaagttgccctccggtgtatgaccgcgatgttacaatggcgggtaaggttaaaggaaataattatattttaagtaaaaccgccaactatctggaagatcagacagcgcgagatcttaattactttggtgctttccgaactaatggacaagatggtcttttagatctaactcttaatgttcctcattctgctggcgttaatcatggtcgaggatttactttccgttatgcgactggcggatctcgtgttgaaacctatgggtataatgcacagggacaaaaagcatttagctataaaatgtatcatgaaggtgataaacctaccccatcggaattgaacgtttatagcaaacaagaagttgaccgtatgtttgttaaaaccgttaaacttgctacagttcctgttgatatcgttgacggttattttaaattagcaactgcgatgattccgcaaaacggtcgtagcgtatttttccgtattcatggtggtaacggatataacgttactgcatacgatcaagttgatattgtagaaattgttattcgcagtggaaataatcgtcctaaaggtgttaacgttattgcataccgccgaaatacaaacaaagcatttgatgttttggctgttaatacttctggtgataactatgatatctacgtgaaatatcagcgttacactgataacgttattgttgaatttggtaaaagtgttgatgttgatctggtagtccatgacgttccagactttgttgttgatcgtcctgttggcgataatgttattggcggtcgcgcggtaactcttttcaacaccgaaaacaaacgaggtgtgttgagttttgacgataacacacaaaatagttatgatattgttcacttgagtaatgataggggtactggacgaaaatatattcgtaaattccgtagcaactataacgaaatgatctggcatgagacggttcaaggttctacttatcgactcgccacgggtagcacagatgcccaggagattctatccgttgaatctagtagctctattgctggaactcataaaggtaatattctttctggtcgaatgatgttgggtggcggtagtaatgttattaccttgcggcgtcctgctggtcaatccaaccatattgcgtttcaagataatcgtactggatctattacccgtcaagggtggatcggttatggtaatgctgatactaacgtttttgaatggtatagtgatgtaggtggtacttctattcgtcaccacatcgacggacagatcgaacttgcaaccggtaacacaaaacgcgtttatactaacgctcaattcatctcaatgaatagcgacgcctaccgtatgatctttggtaattacggtgcattctggcgtaatgacggcactaaagtttatcttctttctactgccgaagatgataaatttggcgggtggaatggaaacagaccgttcatttacgatttgaccaacggtaaagttactttaggtggtgatggtaacgaaggtgcattagttctcgaaagagatagccgtgctgctcgatttgctggtgatgtttatgtagaaaaaggatttcttcatttttctagtgggcgtcagggtgctagcggtttcatgaaaataaaccatttgggtgatattgccagtggacgacacaacattcttcaaatagaagaccctacaggtatacatttctctactgaacgcaatgatgaaaccggaaatattactgcacgttttaaaggctttgtacgtgtagaagctggtgaaattgcatttgatgctaatcgggggtcgcagtctcaatttaccttacacacatggggtaacgagcaacgcaaacaggtttttgaatgtaaggatgctacaggttatcactggtatactgaacgtactcagggtggcactggaaatgttctgttctctatggctggtagtctaaacgttactagcaatatcacaacaactggtgctgatattacgtttaaacgcgctggcaataagcacatctggtttagagatccagacggtttagagttgggcttgatgtattgcgatgatgctggtgctattcgcttccgtggtcagaaacaagcccaggcgtggaaatttgcagataaaatgatccagttggaatctggtactgtatctggtggcggtaatggcctgattcgtggtgaagttgctggcggtagttggtctagctggcgtgaccgtgctgctggccttatggttgggtgtcctcaatccaccaactcggcacataacgtatggaaagcgacgcattggggtaaatatcacattgcagcaatgggtatacatgttcctgacggtactatcggtaacgctcttgctcgtctccatgttcatgatactaactttgactttagcgcctccggtgatatgacggcaggtcgtaacggttcgtttaacgatgtgtatattcgttctgatgctcgccttaaaatcaataaggaagagtataaagagaatgccaccgataaaattaatcgcttgacggtatacacctatgacaaggttaaatctttaaccgaccgtactgtcattgctcatgaagttggtattattgctcaggatcttgaaaaagaattgccggaagcagtaacaacttctaaggtcggcgatcctgataagccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 185 - DNA, 780 bp, Artificial Sequence
  Synthetic:  Ww170 phage
atggcaatatcttctggatgggtaggatcatctgcggtgtccgagactggtcaacggtggatgagcgccgcaatgcaagctgtacgcttaggtcgtccggcgtatatgtcggcaatggtcggacgctctaaagagattcattatagcattggtgctagtaactcttacaataaagacactcttattaactggatgaaagcacaaggatctactccggtagtaattactatcactggtaatattgtttcccaatctactggcgttccttgtcttgacttccctagctcgttaacaaacgaatatgtaacattgatcattaaccccggtgttcatgtttgggggcgtggtggtaatggtggcaataactccgctggtggtgctggtggtaatgcaattaacaacggtataggcacacgcttacgcatcacaaataacggcgctatttgcggtggcggtggcggtggcggcggtgggtattattctcctttttcacaaatgagattaacctttggcggtggtggtgggcgtccgtttggtgctgccggtgggtctgctaatatggaacagggtgctactgctggtactatttccgcgccaggtaaagggtctgtcaacggtgtatataatggcggtaacggtggtgatgctggtggtgctggtggtaaatgtaatatccgtggacagggatcggaatataacggtggtgcggctggtaaggctgttactggcaatgcccctcgctgggataaagtaggcacgatctacggtgctcgtgtgtaa

SEQ ID NO: 186 - DNA, 261 bp, Artificial Sequence
  Synthetic:  Ww170 phage
atgtccaatcagcatgaacaaatgattaatgtcctgaaagtacgtctgtttgacactcaagaaaaggccgcattcttagaaggccaactgaaagatcgtgagcgtgtattgatggaactggtacgcattctgggtattcagccagacgaaaacggcactgtttcccttgatgctatcgtcgaagaagtgaaagcacttctccctaaagacgaagcagcggaagacgctaaagaggaagtagaactgatcacggaggcttga

SEQ ID NO: 187 - DNA, 3948 bp, Artificial sequence
  Synthetic: WW202-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgggcaaattgttaatttaagttgccctcctgtttatgacaaaggctttgatgtaagaggccgcgtggttgtggatgaccttgtgtggagtaataccgcaaactatttcgatgacccgaccgcacgaaatcttgataaatttggggcatttcgtactaatgatatggatggtcatctagcatttgctttgcatattccccatcctagcggtataaatcatgctcgtgggtttgattttacttatggttctaacgttgttcctactgtaaaaacctatggttataacgctgatggtgtattggcatattcatatcgcatgtatcacgaaggtgataagcctagtccgtcagaattaaatgtatacagcaaacaagaagtagatcggatgttccaaaaaaccatcaactttggtgtagaaactggatggtttaaaattgctacagcatttattccgcaaaatgatggacgtagcttgaaaattagattggttggtggaaatgggtggaacgtaggccaaacgggacaatgtaatattattgaacttgttataaggactagcaacggttcccctaaaggaattaactttgttgcatatcatcatgtttctggttacgaaaatcaattttgtgccattaatacaggtgatgacacttatgatatctatgcatactactacgaatttactaatatggtaatggctgaatatcaagcgtccagcgatgttaatttaactgtatttgatcgacctgaatatgtaggcgaaaaacctgtagccgaacatatattcgatgcatatacaatacactcctttaacagtttcagtaaccgtggaacattaaattttgctggcaaccatcaaggacaatatgacattgagcatatgaacgaacaaccgacaaatgctaaaaagatgttgcgtcggtttcgaagctctgccagcgcgacaatctggcatgaaaccgttgatgaccagaattatcgtcttgccactggaggtacagactcagttcaacaattattgttgtcttctgggactggtttgcatattcgtagattgaccatcgatggtggcttaggttccggttctaatgctggtattgatattcgtcgaggaccaaacgaatcaagccattttaattttatggattatcgcactggtcaagatgttcgtaatggttggtttggttttggtgatttgacgaccaaagattttatttggtggaacgataacggtcaaaactcgataaacttgatcgaaaacggtgaattacatattactggcggtagaggccagaaaattgtaatgaatagcgaagttgcattatctgaaaatgctcgtttggctgtcaaaggtggtaactatggtttaatccttcgtaatgatgggactggtttccatatactgactaccgatttaaaagattcttttggtagttggaataatcgcagaccattcagctataattttgcggacggtggattatatttaggtggtactgaaactgctcgttgtttgcatcttggaattgatggtagcactcgtctagaagacaaccttttctttaaagctggttctcgtcaatctatggactatatggaactcgtccattggggggcaagcaatacaggtcgaaataacgttttaagtcttcgtgactcaaaaggatttttagcagaatttgaacgcgtgggggggactgacggcgttaaaaccagattctttggcgaaacattcactgacggtacattatacctaaatcagatgaataatagctctgaacgattctctatcaataactggggaaattcagaagttggtcgcgcggcagtaatggaagttggcgattccaaaggttatcacttctatgcggaacgtagaacagatgacaccgttttatttgatgtatctggtgctttgaccgtgcatggacctaacggaataaccgtcaaaaactcaactggtgcacgccatatctggtttagagatgatagcgatacggaaaaggctgttatctgggctacagatgatggtatgttacatatacgaaataatcatgagggttcatttgctcatcacttccagggcgcaatgattaaactggaagggcgtgttccttatggtgcagcaaaagggcttattcgaggcgaggtagacggtggtgcatatgttgcatggagagatcgccctgctggtttgttggttgactgccagaaaagtattgacagtgctcatgctgtttggaaagcggttgattgggggcgtcaatatatcgctgctatggacgttcattgtccgggtgatggtaataatactgcggcagcggttcttcatgttcaggctgctgattatcaattccatgcaagcggagaatttcatgcctctggtaacgggaactttaacgatgtgtatattcgttcagaccgtcgccttaaagacaatatagaagattatacaggaaatgcgttaagtttgatcggcaaactgaaagtgaaaacttacgataaagttaaatctcttaaagaccgtgaaattatcggtcacgagatcggcattatcgcacaggatttacaagaaatattaccggaagctgtaaaatcttcaaaagttggcaatcttgataatccagacgatgttctgacaatttctaactctgctgtgaatgctcttttaattaaggctattcaggaaatgagtgaagaaattaaagaattgaaaactcctttctttactaaaattgctcgcaaaattagtaaatattttaaattctaa

SEQ ID NO: 188 - DNA, 783 bp, Artificial Sequence
  Synthetic:  Ww202 phage
atggcagtagttggtgttcctggttggattggaagttcagccgcaaatgaaacagggcaacgatggatgagtcaagcggctggtcaattaagattgggtgttccttgctggatgagccaattctccggtcgttcaagagaaattattcatacacttggagcagaccataacttcaatggtcagtggttccgtgatagatgctttgaagcaggtagtacacctatagtgtttaatatcaccggagatttagtatcatattctaaagatgttcctttattctttatgtacggagatacacctaatgaatatgttcagttgaatatacatggcgtaacgatgtatggtcgtggcgggaatggcggtagcaatagtcctggatcagctgggggtcattgtattcaaaatgatattggtgggagactaagaattaataatggtggagctattgcaggtggcggtggcggtggcggtggcgggtattattctcctttttcacaaatgagattaacctttggcggtggcggtgggcgtccgtttggtgcacccggcggatctattgatatgcaatcaggcgcaactgctggtactctttatgctcctggatcggggtccgtgaacggtatctataatggcggaagcggtggtgaggtaggcgccgcaggaggtagatgtaatattcgtggtcaaggatatgaatacaatggcggcgatgctggttatgctgttataggttcttctccaacgtggcaaaatcgcggagctatttacggacctgctgtttaa

SEQ ID NO: 189 - DNA, 261 bp, Artificial Sequence
  Synthetic:  Ww202 phage
atgtccaatcagcatgaacaaatgattaatgtcctgaaagtccgtctgtttgacactcaagaaaaagccgcattcttagaaggccaactgaaagatcgtgagcgtgtattgatggaactggtgcgtgttctgggtattcagccagatgaaaatggcactgtttcccttgatgctatcgtcgaagaagtaaaagcacttctccctaaagacgaagcagcggaagacgctaaagaggaagtagaactgatcacggaggcttga

SEQ ID NO: 190 - protein, 6 aa, Artificial sequence
  Synthetic: insertion sequence
SAGDAS

SEQ ID NO: 191 - protein, 6 aa, Artificial sequence
  Synthetic: insertion sequence
ADAKKS

SEQ ID NO: 192 - protein, 6 aa, Artificial sequence
  Synthetic: insertion sequence
MDETNR

SEQ ID NO: 193 - protein, 6 aa, Artificial sequence
  Synthetic: insertion sequence
SASAAA

SEQ ID NO: 194 - protein, 6 aa, Artificial sequence
  Synthetic: insertion sequence
GAGENS

SEQ ID NO: 195 - protein, 6 aa, Artificial sequence
  Synthetic: insertion sequence
ATLKQI

SEQ ID NO: 196 - protein, 6 aa, Artificial sequence
  Synthetic: insertion sequence
IIQLED

SEQ ID NO: 197 - protein, 6 aa, Artificial sequence
  Synthetic: insertion sequence
GNIIDL

SEQ ID NO: 198 - protein, 5 aa, Artificial sequence
  Synthetic: insertion sequence
IATRV

SEQ ID NO: 199 - protein, 5 aa, Artificial sequence
  Synthetic: insertion sequence
TPGEL

SEQ ID NO: 200 - protein, 5 aa, Artificial sequence
  Synthetic: insertion sequence
GAIIN

SEQ ID NO: 201 - protein, 5 aa, Artificial sequence
  Synthetic: insertion sequence
NQIID

SEQ ID NO: 202 - protein, 5 aa, Artificial sequence
  Synthetic: insertion sequence
GQIVN

SEQ ID NO: 203 - protein, 5 aa, Artificial sequence
  Synthetic: insertion sequence
VDRAV

SEQ ID NO: 204 - protein, 659 aa, Artificial Sequence
  Synthetic:  AG22 phage
MAIYRQGQASMDAQGYVTGYGTKWREQLTLIRPGATIFFLAQPLQAAVITEVISDTSIRAITTGGAVVQKTNYLILLHDSLTVDGLAQDVAETLRYYQGKESEFAGFIEIIKDFDWDKLQKIQEDVKTNADAAAASQQAAKTSENNAKTSATNAANSKKGADTAKAAAESARDAANTAKTGAEAAKSGAESARDAANTAKAGAESARDQAEEYAKQAAEPYKDLLQPLPDVWIPFNDSLDMITGFSPSYKKIVIGDDEITMPGDKIVKFKRASTATYINKSGVLTNAAIDEPRFEKDGLLIEGQRTNLLINSTNPSKWNKSSNMILDRSGVDDFGFQYAKFTLKPEMVGQTSSINIVTVSGSRGFDVTGNEKYVTISCRAQSGTPNLRCRLRFENYDGSAYASLGDAYVNLTDLSIEKTGGAANRITARAVKDEASKWIFFEATIKALDTENMIGAMVQYAPAKDGGGTGADDYIYIATPQVEGGVCASSFIITEATPVTRASDMVTIPIKNNLYNLPFTVLCEVHKNWYITPNAAPRVFDTGGHQSGAAIILAFGSADGDNDGFPYCDIGKSNRRVNENAKLKKMIIGMRVKSDYNTCCVSNARISSETKTEWRYIVSTATIRIGGQTSTGERHLFGHVRNFRIWHKALTDHQLGEIV

SEQ ID NO: 205 - protein, 909 aa, Artificial Sequence
  Synthetic:  SIEA11 phage
MSTKFKTVITTAGAAKLAAATVPGGKKVTLSAMAVGDGNGKLPVPDAGQTKLVHEVWRHALNKVSVDNKNKNYIVAELVVPPEVGGFWMRELGLYDDAGTLIAVSNMAESYKPELAEGSGRAQTCRMVIIVSNVASVELSIDASTVMATQDYVDDKIAEHEQSRRHPDATLTEKGFTQLSSATNSTSESLAATPKAVKAANDNANSRLAKNQNGADIQDKSAFLDNVGVTSLTFMKNNGEMPVDADLNTFGSVKAYSGIWSKATSTNATLEKNFPEDNAVGVLEVFTGGNFAGTQRYTTRDGNLYIRKLIGTWNGNDGPWGAWRHVQAVTRALSTTIDLNSLGGAEHLGLWRNSSSAIASFERHYPEQGGDAQGILEIFEGGLYGRTQRYTTRNGTMYIRGLTAKWDAENPQWEDWNQIGYQTSSTFYEDDLDDLMSPGIYSVTGKATHTPIQGQSGFLEVIRRKDGVYVLQRYTTTGTSAATKDRLYERVFLGGSFNAWGEWRQIYNSNSLPLELGIGGAVAKLTSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 206 - DNA, 3249 bp, Artificial Sequence
  Synthetic: WW13
atggctactttaaaacaaatacaatttaaaagaagcaaaactgcaggagcacgtcctgccgcttcagtattagccgaaggtgaattggctataaacttaaaagaccgtgtactttttactaaagatgaccaaggaaatattattgatctgggttttgctaaaggcggtagtattgacggaaatgttattcatataggaaattataatcaaactggtgattatactttaaatggcaccttcactcagacaggtaattttaatttaactggtattgctcgagtaactcgcgatattattgccgccgggcaaattatgactgagggcggagaacttattacaaaaagttcaggtacagcacatgttcgttttttcgatggcaatagccgcgaacgtggaatcatttatgccccggccaatgatggtttaactacgcaagttcttaatatcagggttcaagactacgccgctggtagcgaaagcacttatgcattttcaggcagtggcctatttacttcacctgaagtatcggcatggaaatctatgtcaactcctcagattttgaccgataaagttattacaaatgggaagaagacaggcgattatgatatctattcattatcaaataacactccattggcagaaagcgaaacggctattaaccacctccgtgttatgcgaaatgctgtaggagcaggtattttccacgaagttaatgttaatgacggaataacctggtattccggagatggcttagacacttatctttggtcgtttaactgggccggtggattgaaagctggtcattctatttctgtaggtcttccgggtggctctaaaggatattctgaattaggaacggcctcaattgctcttggtgataatgacaccggatttaaatggcatcaggacggatattttcatacagtaaacaatggaacaagaactttcatctacggccctgcggaaacacaaagccttagaaaaatggttatgggttattctccggacgggattcttatgacaacgccaccgacagaaaactatgctcttgctactgtagtgacataccacgataataacgcgtttggagatggtcaaactcttttaggatattatcaaggcggtaactatcatcactatttccgcggtaagggtactacaaacattaatactcatggcggtttgttagttactccaggcaatattgacgttattggtggttctgttaatatcgatggtagaaataataattcaactttaatgtttaaaggctataccatgggtcaaagctccgttgataacatgtatatagctgtttggggaaatacatttactaatcctagtgaaggcacccgtaaaaatgtcatggaaatttctgatgatattggatggatgcattatattcaacgaaataaagataatacagttgaagccgtattaaatggtcaacagacaattaacgaaaatattattgcgaaaaaggatatttgggttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattc

SEQ ID NO: 207 - DNA, 3309 bp, Artificial Sequence
  Synthetic: PP-1
atggctactttaaaacaaatacaatttaaaagaagcaaaacggcaggtcaacgtccagctgcttcagtattagccgaaggtgaattggctataaacttaaaagatcgtgtactttttactaaagatgatcaaggaaatattattgacttaggttttgctaaaggcggtagtattgacgggaatgttattcataaaggcaattataaccaaactggtgattatactttaaacggtacattcacccagactggtaattttaatttaactggtattgctcgagtaactcgcgatattattgccgctgggcagattatgactgaaggcggagaacttattacaaaaagttcaggaacggcacacgttcgttttcatgattccgccgaccgtgaacgcggtattattttttctcctgctaatgacggtttaactacacaagtagttaacatcagagttcaagattacaaagctagttcagaaagcactttcgcttttaatggaaatggtttgttttcttcaccagaagtttttgggtggaaatctgtatcaactccggtaatttataccaataaagttatcaccaataaaaaagttaaagatgattatgacatctattcgatggcagacaatgttccattgtctgaaatcactactgctattaatcatcttcgtgttatgcgtaatgcagttggttctggtattttccatgaagttaaagataatgatggaataacatggtatagtggagatggattagacgcttatctttggtcatttacttggagcggcggaattaaatcaagtcactcaatttccatcggtttaacacccggacctaaggattactcaatattaggaccgtctagtatcgctttaggagataatgatactggatttaaatggcatcaagacggatattatttcagtgttaacaatggcacaaaaacgtttttatttagtcctagcgaaacaactagcctaagaaaatttgtagctggatattctactaatggaaccgatttaactactcctccgactgaaaactatgctcttgctactgtcgtgacatatcacgacaataacgcgtttggagatggtcagactcttttaggatattatcaaggcggtaactatcatcattatttccgcggcaagggcactacaaacattaatactcacggcggtttgttagttactccaggcaatattgacgttattggtggttctgttaatatcgatggtagaaataatgcttctacagcgatgtttaaaggtaacacaacaggtagtagttctgtggataacatgacaatttctgtgtggggtaatacatttactaatcctagcgaaggtaatcgcaaaaatgtcatggaaatttccgatgcaactagctggatgagctatattcaaagacttactactggtgaagtagaaatgaacgttaacggttcatttgaatcatctggtgttactgctggaaatagaggagttcacacaacaggcgaaatttcatctggagcagtgaatgctcttcgcatttggaatgcagattatggagtcatttttagacgttcagaaggtagtcttcatattattccaactgcttatggtgaaggcaaaaatggtgatattggtccacttcgtccatttagtatagctttagatactggtaaggttgttattccagatttagaatcaagttataacacgtttgctgcaaatggctacattaaatttgctggtcatggggctggtgccggcggttatgatattcagtattcacaagctgctcctattttccaagaaatcgatgatgctgctgtaagcaaatattatcctattgttaaacagaagtttttaaacggtaaagctgtctggtctttaggtactgaaattaattcaggtacatttgttttacatcatctaaaagaagatggttcacaaggccatacatcaagatttaatgctgatggtacagttaatttccccgataacgttcaagtcggcggcggtgaagctactattgctagaaacggtaatatcttctctgatatttggaaaacatttacttctgccggagaaaccacaaatattcgcgatgcaatagctactcgtgtttctaaagaaggcgacacgatgactggtaaattgactttatcagcaggcaatgatgctctcgttttaactgcgggcgaaggtgcttcatcacatatccgtagtgatgtaggtggtacaaataactggtatataggcaaaggtagcggcgacaacggtctaggtttttacagttacattacacagggtggtgtatacataacaaataacggcgaaatagcgctttctcctcaaggacaaggaacatttaattttaatagagaccgccttcatataaacggtacacaatggactgcgcaccagggtggtggctgggaaaaccaatggaatcaagaagctccgatatttatagattttggtaatgttggtaatgatagttattatcctattattaaaggaaaatctggtattactaatgaaggatacatatctggcgttgattttggtatgcgacgtattactaatacctgggcacaaggtattattcgtgtaggtaaccaggaaaatggttctgatccacaagctatctatgaatttcatcacaatggagttctgtatgttcctaacatggttaaaactggagcaagattatcagctggcggtggtgacccggtgtggcaaggcgcatgcgttgttattggtgataatgatactggattagttcatggtggtgacggccgaatcaatatggttgcaaatggaatgcatattgcttcatggtcgtccgcttaccatctccatgaaggtctttgggataccactggtgctttgtggactgaacaaggaagagctattatttcttttggtcatttagtccaacagagcgatgcctattccacatttgttcgagatgtttatgtccgttctgatattcgtgttaaaaaagaccttgttaaatttgaaaatgcttctgagaagctttccaaaattaacggttacacttatatgcagaagcgaggcctagatgaagaaggcaatcagaaatgggaacctaacgccggtttaattgctcaagaagttcaagctattttaccagaattagttgaaggtgaccctgatggcgaagctttacttcgtttgaactataacggtgtaattggtttaaatacagctgcaatcaatgagcatactgcagaaattgcagaacttaaatcagaaatcgaagaacttaaaaaaatagttaaatcattgttaaaa

SEQ ID NO: 208 - DNA, 2943 bp, Artificial Sequence
  Synthetic: WW55
atggcagatttaagcagaatccaatttaaacgcactagcactaaaggtcgtcgtcctgatgctagtacgatgaatccgggggaattggcaatcaaccttgcggatcaatatcttcttactaaaaatgattccggtgctattatcaatttaagttgtcctcctgtttatgaccgcgatgttacaatggcgggtaaggttaaaggtaataattatatcttaagtaaaaccgctaactatctggaagatcagacagcgagagatcttaactactttggcgctttccgtaccaatggtcttgatggtcttctcgaactcacgctaaacgttcctcactcttccggtgtccaacatggtcgaggatttactttccagtatgggcacactggatcgcgtgtagaaacttatggctataataaagaaggtcaaaaagcatttagttataaaatgtatcacgaaggtgataaaccaactccaggagaattgaacgtctatagcaaacaagaaattgaccgtatgtttgttaagaacgttaaaatggttgttccttctggtggtgcaacccgtggttattttaaaattgcatccgcaatgatcccgcagagtggtcggatggcgtttctgcgaatctatggtggtaatggatataatgtaaactcatatgatcaagttgattttcttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgacgtcgcattgactgttcatgatgttcctgaattttcggcgactaaaccagaaaccggaactaaatttgatgctcgtgttattacgatgttcaacaccgaaaacaaagccggaacattgatgtttgataataacaatcagttaacctatgatattgttagccttagcaatggtcctgatgatgttagaaattatctgcgtaaattccgaagtaaagcgggtgaaatgatttggcatgaaaccgttcagggtgctgtatatcgtcttgctactggaactactgattctacggaagttcttagagttgattctaacagtgctctcccgggtagctataaaggatatgtaattactggtaaaatggaattgcacggtagcggtagtgcgatgaatttacaccgccagactggtcaagctgcatatatggcgtggtgggatcgtcgtgatggtaaaaaccaacgtagcggttatatcggtcatgcggatggtactactgatggttttgtgtggcgtaatgatgttggtgcgaactcatttgatttggaaagtagtggacaagtaaatttgactacaggaaaaacaaaaattgtatataccaacggacaatattattccgctaactctgatgcattccgtatgatttacggcaattatggcgcattctggcgaaatgatggtggtaaagtttatctgttgtctactgccgaaaatgatagatttggtggatggaacggcaaccgaccattcatttacgacctgtcaactggtaaagttactttaggtggcgacggtaacgaaggcgcattagttctcgaaagagatagccgtgcggctagatttagcaacagcgtattcttagaaaaaggattgcttactttctctgcgggtgggaatcagtcaatggattctttcacgattaaccattgggggaatagtaacgctggacgatataatgttttacaatttgaagacacgaaaggaacacattttacaaccgaacgtaatgctgatggtggattgcttgctcacttccgaggggatttaaccacagaagggaaattaacgtggggtaagggtacagccacatctagctttaacattcgtgcatggggtaatagtgattcccgtaaacaggttttcgagtgtgtagatgaaagtggttggcattggtatacccagcgaccgggcggtcctggtacttctgcaattgagtttgccatcaatggtactgttaagcctcaagcaattcacactggcggtaatattcttttgaacggtgctgatattgagtttcgtcgcactggtaataagcatttgtggtttagagatccaaacggattagaattgggtttgatttattgtgatgacaacggtgtcattcgttttcgtggtcagaaacaaggtcaagattgggtatttgccaataagatgatccaattagggaccgcttctactgttggtggatctggtaacggtttgattcgcggacaagttcaaggtggtgcttgggcacaatggagagaccgtgctgctggaatccttgtagactgtcagcaatctactgattccgctcataacatctggaaagcgactcattggggaaaatatcatattgcggcaatgggtgtacacgttcctagcggcactataggtaatgctatggcacgtctaaacgtaaatgacgccaactttgactttagcgcctccggtgacatgtcggcagggcgtaacggttcgtttaacgatgtttatattcgttctgatgctcgccttaaaatcaataaggaagagtataaagagaatgccaccgataaagttaatcgcttaactgtatacacctatgacaaggttaaatctttaaccgaccgtactgtcattgctcatgaagttggcattatcgcacaggatcttgagaaagaattgccggaagcagtaacaacctcgaagatcggcgatccagataaaccagaagagatcttaacaatttctaactctgctgtcaacgctcttttaattaaggcgtttcaggaaatgagcgaagaattgaaagccgttaaagctgaactagcggaacttaaaaagaat

SEQ ID NO: 209 - DNA, 2940 bp, Artificial Sequence
  Synthetic: WW34
atggcagatttaagcagaatccaatttaaacgcactagcactaaaggtcgtcgacctgatgctggtacgatgaatccgggggaattggcaatcaaccttgcggatcaatatcttcttactaaaaatgactccggtgctattatcaatttaagttgtcctccggtttatgacagcgatgttacaatggcgggtaaggttaaaggaaataattatattttaagtaaaaccgctaattattttgaagaccaaaccgcgcgagatcttaattattttggtgcgtttcgaccgaataatgctgatgattggtctaacttgattctgaacattcctcatcccagcggtaaagcacacggtcgcgggtttgaatttcaatatggttctagttcctctcaggttaaaacctatggctttgataaggatggtaacaagagattcagctttcgcatgtatcacgaaggtgataaaccaactccaggagaattgaacgtctatagcaaacaagaaattgaccgtatgtttgttaagaacgttaaaatgtctactccttctggtgaagcaacccgtggttattttaaaattgcatccgcaatgatcccgcagagtggtcggatggcgtttctgcgaatctatggtgggaacggatttaatgttaactcctacgatcaggtggatttccttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgatgttgcattgactgttcacgatgttcctgaattttcggcgactaaaccagaaaccggaactaaatttgatgctcgtgttattacgatgttcaacaccgaaaacaaagccggaacgttgatgtttgataataacaatcagttaacctatgatattgttagccttagcaatggtcctgatgatgttagaaattatctgcgtaaattccgaagtaaagcgggtgaaatgatttggcatgaaacagttcagggtgctgtatatcgtcttgctactggaactactgattctacggaagttcttagagttgattctaatagtgctataccaggtagctataaaggatatgtaattactggtaaaatggaattgcatggtagtggtaattcgatgattttacatcgccagactgctcaagccgcgtacatgtcgtggtgggatcgtcgtgatggcaaaaaccaacgtagcggttatatcggtcatgcagatgggactagtgatgctattgtgtggaataatgatattggacaaaacagtgctgttctagaaacatctggtcaaatatctttcagaacaggtgcaaccaaaattgtatataccaacggacaatattattccgctaactctgatgcataccgtatgatctttggtaattacggtgcattctggcgtaatgacggcactaaagtttatcttctttctactgctgaaaatgataagtatggtggatggaatgcctatcgtccattcatttatgatttaacttccggtaacgttcaattaggcggtgatggtaacgaagatgcattaacgttagaatgtgcttctcgtgccgctcgctttagtaatgacgtttacattaagaaagggcttttgactttcgacgctgggcgcgctggatctcgcgattatattcgatttaatcattggggtgatagtaataatgcccgtgataacgttttgtgcatagaagatagtcaaggccgacattttagcacagaacgtgcgatgggtactggtgctcttaaagcatacttcttaggcgatcttgaagtcggtggtaagtttacttggggtaaaaatacagctacatctagctttaatattcgtgcatggggtaatgattcccgtaaacaagtattagaatgcgcggatgaaagtgggtggcattggtacacacaacgaacgggcggtcctgatacttctgcaattgattttgccatcaatggtactgttaggcctcaagcaattcacactggcggtaatatcactatcaacggtgctgatattgagtttaaacgcactggcaataagcacatctggtttagagatccgaacggtttagagttaggcttgatgtactgcgatgatgctggtgctattcgcttccgtggtcagaaacaagcccaggcgtggaaatttgcagataaaatgatccagttggaatctggcactgtatccggtggcggtaatggcctgattcgtggtgaagttgctggcggtagttgggctagctggcgtgaccgtgctgctggtcttatggttgggtgtcctcaatccaccaactcggcacataacgtatggaaagcgacgcattggggtaaatatcacattgcagcaatggctgtacatgttcctgatggtactattaccaatgctttagctcgcctaaacgttcatgacgccaactttgactttagcgcctccggtgacctgtcggcagggcgtaatggttcgtttaacgatgtttatattcgttctgatgctcgccttaaaatcaacaaggaagagtataaggagaatgccaccgataaagttaatcgcttgacggtatacacctatgacaaggttaaatctttaaccgaccgtactgtcattgctcatgaagttggtattattgctcaggatcttgagaaagaattgccggaagcagtaacaacttctaagatcggcgatcctgataagccagaagagatcttaacaatttctaactctgctgtcaacgctcttttaattaaggcgtttcaggaaatgagcgaagaattgaaagccgttaaagctgaactagcggaacttaaaaagaat

SEQ ID NO: 210 - DNA, 3906 bp, Artificial Sequence
  Synthetic: WW14
atggctactttaaaagcgatacaatttaaaagaagtaaaactccaggagccaagcctactgtagaccagttggttgaaggtgaactggctattaacttacgcgaccgcactatttttactaagtcagaccagaaccagattattgatttaggctttgcaaagggtggacaagttgacggtgatgtaactattaacggaactctgaatttaaacggccctgaaattgttgcctccggtggttatatagaatttaactatcgtacgacaggtagtggctcttgggcgggtcagcacgcggccaaagctcctatttttgttgatttaagtgcggcgttatctacttcagaatacaacccactgtttaagcagcgttacaaagatggaacattttcagcaggtacattagttactgaaggtagttttaaatttcactatattaatgaagctggtgattcgaaatattggacctttaatcgtaatggtaattttcaagttgataccggtagtttatttgtatcgggtggtaatatttccgcttcaggcaatatcaactctgcctcagggtttgtgtctgcgcctcagattaatactaaaaatattattttagatacaaaagcatttggacaatacgacagtcagtctttagttaattacgtatacccaggcaccggcgaaacaaatggtgtaaactatcttcgtaaagttcgtgctaaatccggcggcactatgtggcatgagctttgcactgcccaattaggccaagccgatgaaatgtcttggtggacaggtaatacccctcagtctaaacaatacggtgttcgtaacgacggccgtttgattggtagaaatagccttgcattaggtactatgactaccgatttcccatctagcgattatggtaataccggagctatgggtgacaaatacctagttttaggtgatactgcaaccggtttaaaatatatcaaacaaggcaattttgatttagttggtggtggatattctgttgcgtcaattaccacagacggtttccgtggcacaagtaaaaccttatttggtcgtagtaatgaccaaggtttaacatggcttcttcctggtcaaaactctgcaatggtttctatcagaaccgaaatagatggtaataactctggcgatggccaaacccatttaggttataattctaatggtaaactttatcattatttccgtggtaccggtcgtgtagccatttctatggcagaaggtatgattattgaacctggtattttaaatattaagaccggggttaacgaattaaatcttagagcagacggcacagtttctactacacagcgtttaatggttaataacggcttagttcttaacgcaaacaataatacttctgcattggcattaactgctcctaccggtgttgatggtacaaaaaccattaactgggacgctggtacccgaaatggccagaacaaaaataccgttaccatgaaagcatggggtaactcatttaacgcgggtggtggtaatagagaaactgtattcgaagtatcagattcacaaggatattatttctatggccaacgtactaatccggcttccggtgaaactgtaggccctattaacttcaagttcaacggttctgttgaaacaggtcatttttctagtctcggaaatataagtgcatctggtaccggttcttttggtggcaatgttaccatgactaatggcctgtttgtccaaggcggcgcttcaattaatggccaagttaaaatgggtggtactgctgacgcattaagaatttggaacgctgaatatggtatgattttccgtcgttcagaaacgggttcttctgcttcattccatcttattcctacccttcaaaacgccggtgaaaatggcggaataagtgaccttcgtccactatctatcaatttagctagcggcacggttataatgggtaataaaagcacaggtggcccacttttcacagtagacaacgtaagtaaatttgttcaaaccgactgtagattgcgtgttaatatggattctgatggtattgttttgaatgcttcatctcaagcagcatccaactttattcaaggacgtaaagcagatgttacaaaatggtatctaggtattggcgatggtggcaacgtcgttcgtatgcacaactatacttattcacatggtattgcattaaactctgataccgttgatataaccaagcctcttaaaataggttctgatattcgtatcggtactgatgggaatattataggcagtgctactttagataactttaaaaacctgaatacaacattagaccataaagttaatatgggcggttggtccggcggtgctactacaggttggtataaatttgctactgtagaaattccacaggcaacaggcacggcatcttttaaaatatttggcggttccgggtttaattttaaaagttacggtcaggcttcaatagctgaaataattcttagaaccggtaataataaccctaaaggccttaatgccacgttgtggaataggacttctgaagctatttcccagattgcttcggttaatacaagcgaagatatctatgatatttacgtttacttaggtgggtattctaattctttggtggtagaatatacctgcagcagcaatagtaaagtaaccgtagtaggtatggatggtggtgtccagcctttggtagaaacattacctgaaggtcatgttgtaggtaaatctgtaagaatgctgaacaaccttgacggaatgtttgccgctggcgaatcggatattgttactcgtggtgaatatgttaccaataaccaaaaaggtatgcgtattaaatctaaaggtaatgatttagattctaatgctgctttacttagaaacgacggtggaagtttttatattttagctacagataaaaatacgacagaaaaacccgatgcggctaatggtgattggaatggcttaagacctttctcgattaatatggctgatggtcgcgttggtatgaaccacggattgaatattactggcggtggtctgaacgttaccggcggtaatactaaccttggtaatattacatctcgtgtagtttcttcggcacgcgccgggtccggttggggtgataactctgatgctatgaaatccaaaattacctttatggctgaccacggtgatttatctaattcaggcagttattatcctatcgtaggcgcatacagcaactatggttcagcgggttatcgtcaaacctttgaatttggatgggtcggctctggtagcaccgcaaattggcgagaaggtattattcgtattcgcggtgataatgctaacggccagcaagcaagatggcgctttacaatggacggtattttaggttgccctggtaaagtagagatgccagaaacaagcgcatttggtatcaacacaacaaatggatttggtggtaactcgattgtaattggtgatagcgatactggttttagacaagtcggtgatgggcttttagaagtttggactaacgcctcacgccgaatgagattccaaggcggtgatacctattcagatatgaatattaacgccccgaacgtttatattcgttctgatattcgtttgaaatctaacttcaaaccgattgaaaatgctcttgataaggttgaacagctagacggtttaatctatgataaagctgattatattggcggcgaagttgttcataccgaggccggtgttattgctcagagtttggaaaaagtattgcctgaagctgtccgtgaagttgacgacattaaaggtaacaaagttcttaccgtttcaacccaggcacaagttgctctgttaattgaagcagttaaaactctgtcggctaaagttaaagaacttgaagcaaaacttaat

SEQ ID NO: 211 - DNA, 2928 bp, Artificial Sequence
  Synthetic: WW170
atggcagatttaagcagaatccaatttaaacgcactagcactaaaggtcgtcgacctgatgctagtacgatgaatccgggggaattggcaatcaatcttgcggatcaatatcttcttactaaaaatgattccggtgctattatcaatttaagttgccctccggtgtatgaccgcgatgttacaatggcgggtaaggttaaaggaaataattatattttaagtaaaaccgccaactatctggaagatcagacagcgcgagatcttaattactttggtgctttccgaactaatggacaagatggtcttttagatctaactcttaatgttcctcattctgctggcgttaatcatggtcgaggatttactttccgttatgcgactggcggatctcgtgttgaaacctatgggtataatgcacagggacaaaaagcatttagctataaaatgtatcatgaaggtgataaacctaccccatcggaattgaacgtttatagcaaacaagaagttgaccgtatgtttgttaaaaccgttaaacttgctacagttcctgttgatatcgttgacggttattttaaattagcaactgcgatgattccgcaaaacggtcgtagcgtatttttccgtattcatggtggtaacggatataacgttactgcatacgatcaagttgatattgtagaaattgttattcgcagtggaaataatcgtcctaaaggtgttaacgttattgcataccgccgaaatacaaacaaagcatttgatgttttggctgttaatacttctggtgataactatgatatctacgtgaaatatcagcgttacactgataacgttattgttgaatttggtaaaagtgttgatgttgatctggtagtccatgacgttccagactttgttgttgatcgtcctgttggcgataatgttattggcggtcgcgcggtaactcttttcaacaccgaaaacaaacgaggtgtgttgagttttgacgataacacacaaaatagttatgatattgttcacttgagtaatgataggggtactggacgaaaatatattcgtaaattccgtagcaactataacgaaatgatctggcatgagacggttcaaggttctacttatcgactcgccacgggtagcacagatgcccaggagattctatccgttgaatctagtagctctattgctggaactcataaaggtaatattctttctggtcgaatgatgttgggtggcggtagtaatgttattaccttgcggcgtcctgctggtcaatccaaccatattgcgtttcaagataatcgtactggatctattacccgtcaagggtggatcggttatggtaatgctgatactaacgtttttgaatggtatagtgatgtaggtggtacttctattcgtcaccacatcgacggacagatcgaacttgcaaccggtaacacaaaacgcgtttatactaacgctcaattcatctcaatgaatagcgacgcctaccgtatgatctttggtaattacggtgcattctggcgtaatgacggcactaaagtttatcttctttctactgccgaagatgataaatttggcgggtggaatggaaacagaccgttcatttacgatttgaccaacggtaaagttactttaggtggtgatggtaacgaaggtgcattagttctcgaaagagatagccgtgctgctcgatttgctggtgatgtttatgtagaaaaaggatttcttcatttttctagtgggcgtcagggtgctagcggtttcatgaaaataaaccatttgggtgatattgccagtggacgacacaacattcttcaaatagaagaccctacaggtatacatttctctactgaacgcaatgatgaaaccggaaatattactgcacgttttaaaggctttgtacgtgtagaagctggtgaaattgcatttgatgctaatcgggggtcgcagtctcaatttaccttacacacatggggtaacgagcaacgcaaacaggtttttgaatgtaaggatgctacaggttatcactggtatactgaacgtactcagggtggcactggaaatgttctgttctctatggctggtagtctaaacgttactagcaatatcacaacaactggtgctgatattacgtttaaacgcgctggcaataagcacatctggtttagagatccagacggtttagagttgggcttgatgtattgcgatgatgctggtgctattcgcttccgtggtcagaaacaagcccaggcgtggaaatttgcagataaaatgatccagttggaatctggtactgtatctggtggcggtaatggcctgattcgtggtgaagttgctggcggtagttggtctagctggcgtgaccgtgctgctggccttatggttgggtgtcctcaatccaccaactcggcacataacgtatggaaagcgacgcattggggtaaatatcacattgcagcaatgggtatacatgttcctgacggtactatcggtaacgctcttgctcgtctccatgttcatgatactaactttgactttagcgcctccggtgatatgacggcaggtcgtaacggttcgtttaacgatgtgtatattcgttctgatgctcgccttaaaatcaataaggaagagtataaagagaatgccaccgataaaattaatcgcttgacggtatacacctatgacaaggttaaatctttaaccgaccgtactgtcattgctcatgaagttggtattattgctcaggatcttgaaaaagaattgccggaagcagtaacaacttctaaggtcggcgatcctgataagccagaagagatcttaacaatttctaactctgctgtcaacgctcttttaattaaggcgtttcaggaaatgagcgaagaattgaaagccgttaaagctgaactagcggaacttaaaaagaat

SEQ ID NO: 212 - DNA, 2898 bp, Artificial Sequence
  Synthetic: WW212
atggcagatttaaacagaatccagtttaaacgcactagcacagccggacgtaaaccggatgctggtacgatgaatccgggagagttggcaattaacttagcagaccaatatctgcttactaaaaatgatgatgggcaaattgttaatttaagttgccctcctgtttatgacaaaggctttgatgtaagaggccgcgtggttgtggatgaccttgtgtggagtaataccgcaaactatttcgatgacccgaccgcacgaaatcttgataaatttggggcatttcgtactaatgatatggatggtcatctagcatttgctttgcatattccccatcctagcggtataaatcatgctcgtgggtttgattttacttatggttctaacgttgttcctactgtaaaaacctatggttataacgctgatggtgtattggcatattcatatcgcatgtatcacgaaggtgataagcctagtccgtcagaattaaatgtatacagcaaacaagaagtagatcggatgttccaaaaaaccatcaactttggtgtagaaactggatggtttaaaattgctacagcatttattccgcaaaatgatggacgtagcttgaaaattagattggttggtggaaatgggtggaacgtaggccaaacgggacaatgtaatattattgaacttgttataaggactagcaacggttcccctaaaggaattaactttgttgcatatcatcatgtttctggttacgaaaatcaattttgtgccattaatacaggtgatgacacttatgatatctatgcatactactacgaatttactaatatggtaatggctgaatatcaagcgtccagcgatgttaatttaactgtatttgatcgacctgaatatgtaggcgaaaaacctgtagccgaacatatattcgatgcatatacaatacactcctttaacagtttcagtaaccgtggaacattaaattttgctggcaaccatcaaggacaatatgacattgagcatatgaacgaacaaccgacaaatgctaaaaagatgttgcgtcggtttcgaagctctgccagcgcgacaatctggcatgaaaccgttgatgaccagaattatcgtcttgccactggaggtacagactcagttcaacaattattgttgtcttctgggactggtttgcatattcgtagattgaccatcgatggtggcttaggttccggttctaatgctggtattgatattcgtcgaggaccaaacgaatcaagccattttaattttatggattatcgcactggtcaagatgttcgtaatggttggtttggttttggtgatttgacgaccaaagattttatttggtggaacgataacggtcaaaactcgataaacttgatcgaaaacggtgaattacatattactggcggtagaggccagaaaattgtaatgaatagcgaagttgcattatctgaaaatgctcgtttggctgtcaaaggtggtaactatggtttaatccttcgtaatgatgggactggtttccatatactgactaccgatttaaaagattcttttggtagttggaataatcgcagaccattcagctataattttgcggacggtggattatatttaggtggtactgaaactgctcgttgtttgcatcttggaattgatggtagcactcgtctagaagacaaccttttctttaaagctggttctcgtcaatctatggactatatggaactcgtccattggggggcaagcaatacaggtcgaaataacgttttaagtcttcgtgactcaaaaggatttttagcagaatttgaacgcgtgggggggactgacggcgttaaaaccagattctttggcgaaacattcactgacggtacattatacctaaatcagatgaataatagctctgaacgattctctatcaataactggggaaattcagaagttggtcgcgcggcagtaatggaagttggcgattccaaaggttatcacttctatgcggaacgtagaacagatgacaccgttttatttgatgtatctggtgctttgaccgtgcatggacctaacggaataaccgtcaaaaactcaactggtgcacgccatatctggtttagagatgatagcgatacggaaaaggctgttatctgggctacagatgatggtatgttacatatacgaaataatcatgagggttcatttgctcatcacttccagggcgcaatgattaaactggaagggcgtgttccttatggtgcagcaaaagggcttattcgaggcgaggtagacggtggtgcatatgttgcatggagagaccgccctgctggtttgttggttgactgccagaaaagtattgacagtgctcatgctgtttggaaagcggttgattgggggcgtcaatatatcgctgctatggacgttcattgtccgggtgatggtaataatactgcggcagcggttcttcatgttcaggctgctgattatcaattccatgcaagcggagaatttcatgcctctggtaacgggaactttaacgatgtgtatattcgttcagaccgtcgccttaaagacaatatagaagattatacaggaaatgcgttaagtttgatcggcaaactgaaagtgaaaacttacgataaagttaaatctcttaaagaccgtgaaattatcggtcacgagatcggcattatcgcacaggatttacaagaaatattaccggaagctgtaaaatcttcaaaagttggcaatcttgataatccagacgatgttctgacaatttctaactctgctgtgaatgctcttttaattaaggctattcaggaaatgagtgaagaaattaaagaattgaaaactcctttctttactaaaattgctcgcaaaattagtaaatattttaaattc

SEQ ID NO: 213 - DNA, 1977 bp, Artificial Sequence
  Synthetic:  ag22 phage
atggcgatttacagacaaggccaagcgtctatggacgcgcaaggttatgtaactggttacggtacaaaatggcgtgagcaattaacattgattcgcccaggcgcaactattttctttcttgctcaacctttgcaagctgctgtgattacagaagtgattagcgatacaagcattcgcgcaattactactggcggcgcggtagtccagaagacaaattacctgatcttgcttcatgactcgttaacggttgacggtcttgcgcaagacgtagcggaaacgctgcgttattaccaggggaaggaatcggagtttgctggatttattgagatcatcaaggattttgattgggataagctacagaagatccaggaagacgtaaagacaaatgctgacgcagcagcagcaagccagcaggcagctaaaaccagcgagaataacgcgaagacaagcgcaacaaatgcagcgaatagcaagaaaggtgctgatactgcaaaggctgccgctgaatccgcgcgcgacgctgcaaacactgcaaagactggcgctgaagcagcaaagtctggcgctgaatccgcgcgtgacgctgcgaacactgcaaaggcaggagctgaaagtgcgcgagatcaagcggaggaatacgcaaagcaggcggcagaaccttacaaggacttattgcaaccgttgccggacgtgtggataccatttaatgactccctggatatgattaccggattctcgccgtcatacaaaaagattgttataggtgacgatgagatcacgatgccaggtgacaagatagttaagtttaaacgagcatcaaccgctacttacattaataagtctggggtgcttactaatgctgctattgatgaacctagatttgaaaaggatggtctgctcattgaggggcaaagaacaaaccttcttataaatagtaccaatccttcaaaatggaacaagtcatcaaatatgatcttagatagatcaggtgtagatgatttcggattccagtacgcaaaatttacattaaaaccagaaatggtaggacaaacttcatcgattaacatagtaaccgtttccggcagtagaggttttgatgtaacaggaaatgaaaagtatgtaaccatatcatgcagggcgcaaagtgggactccaaatttaagatgccgattacgatttgaaaactacgatggatctgcttatgcatctttgggtgatgcttacgtaaatctgacagatttatcaattgaaaaaactggcggcgctgcaaatcgtattactgcaagggctgttaaagatgaagcaagcaaatggattttctttgaggcaacaattaaagcgcttgatacagaaaatatgatcggtgcaatggtgcagtatgcaccagcaaaagatggagggggcactggtgcagatgattatatttatattgctacccctcaagttgaaggaggtgtgtgcgcttcatcgtttattattacagaagcgactccagtaacacgggcaagcgatatggtgacaatcccaatcaagaataacctttataatcttccttttactgttctttgtgaggtacataagaactggtatataacgccaaatgctgcgcctcgtgttttcgatactggaggtcatcaatctggtgcggcaattattcttgctttcggatctgccgatggcgataatgatggattcccttattgcgatataggtaaatcaaacagaagggttaacgagaatgcgaaactaaaaaagatgatcataggaatgagagtaaagagtgattacaatacttgttgtgtaagtaatgccagaatatcaagcgaaacaaaaacggaatggagatatatagtatcaacggctactataaggattggcggacaaacaagtacaggcgaacgccatcttttcggtcacgttagaaacttccgtatatggcacaaggcactaacagatcatcaattgggggaaattgta

SEQ ID NO: 214 - DNA, 2727 bp, Artificial Sequence
  Synthetic:  SIEA11 phage
atgagcacgaaatttaaaaccgttatcactactgccggagccgcaaagctggcagccgccactgtccccggcgggaaaaaagtaaccctgtctgcaatggccgtgggtgacggtaatggcaaattgccggtgccggatgccggtcagacgaaactggtgcatgaggtctggcgtcacgctctgaataaagtcagcgtggataacaagaataaaaactatatcgtggctgaactggttgtaccgcccgaagtgggcggcttctggatgcgtgagcttggtctgtatgacgatgccggaacactgattgcggtatccaacatggctgaaagctataagccagaactggctgaaggctccgggcgtgcgcagacctgccgcatggttattattgtcagtaacgtggcgtccgttgagctgagtattgatgccagcacagtgatggcgacgcaggattacgtcgatgacaaaatcgcagagcatgagcagtcccgccgccatcctgacgccacgctgacagaaaaaggttttactcagttaagcagtgcaacaaacagcaccagtgagtcattggcagcaacgccaaaagcggtcaaggcagcaaatgacaacgcaaattcacgtctggcgaaaaatcagaatggtgcagatatccaggataaatcagcttttctggacaatgttggcgttaccagcctgacgtttatgaaaaacaatggcgaaatgccggttgatgctgatctgaatacgtttggttctgttaaggcttattcaggtatctggtctaaagcaacgtccaccaacgcaacactggagaaaaacttccctgaagataatgctgtcggtgtgcttgaggtttttactggcggcaattttgcaggcacgcaacgctataccacacgtgacggaaatttgtatatccgcaaactcattggaacatggaatggtaatgatggaccatggggagcatggcgccatgttcaggctgtaacgcgagctctaagtacgaccattgaccttaactctctcggtggcgcagaacatttaggtctatggagaaacagcagttcagcaatagcttcttttgaacgacattaccccgagcagggaggagacgcgcagggcattctggaaattttcgaaggtgggctatatggacgcacacagcgttatacaacccgtaacgggactatgtatattcgcggcctgacagccaaatgggatgcagaaaatccacagtgggaagactggaaccaaattggttatcagaccagtagtaccttctatgaggatgacctggatgatttgatgtctccaggtatttacagtgtgacaggcaaagcgacccacaccccaatccaggggcagtctggttttctggaagtcatcaggcgcaaggatggtgtctatgttttgcaacgttacacgaccacaggaaccagcgcagctacaaaagaccgtttatatgagcgagtgtttcttggtggctcatttaacgcgtggggggagtggcgacagatttataactcaaactctttgccgttagagttgggtatcggtggcgcagtggcaaaactcaccagcctggactggcagacatacgattttgtgccgggcagtctgataaccgttcggctggataacatgaccaatattcccgacggtatggactggggcgtcattgatggcaacctgataaacatctcagtcggtccgagtgatgattctggttcgggacgctcaatgcatgtatggcgcagcactgtaagtaaagccaactaccgcttttttatggtgcgtatttcaggaaatccgggaagccgcacgatcacgacaagacgtgtgccaattatcgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactattggtggggcatcaacgttaattcttcattttaatatcggggaaggaagttgtcccgccgcccagtttcgcgttaattataagaacggtggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtg

SEQ ID NO: 215 - protein, 838 aa, Artificial Sequence
  Synthetic: O111
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSASGALQKNQNGADIPGKDTFTKNIGACRAYSAWLNIGGDSQVWTTAQFISWLESQGAFNHPYWMCKGSWAYANNKVITDTGCGNICLAGAVVEVIGTRGAMTIRVTTPSTSSGGGITNAQFTYINHGDAYAPGWRRDYNTKNQQPAFALGQTGSRVANDKAVGWNWNSGVYNADISGASTLILHFNMNAGSCPAVQFRVNYRNGGIFYRSARDGYGFEANWSEFYTTTRKPSAGDVGAYTQAECNSRFITGIRLGGLSSVQTWNGPGWSDRSGYVVTGSVNGNRDELIDTTQARPIQYCINGTWYNAGSI

SEQ ID NO: 216 - protein, 791 aa, Artificial Sequence
  Synthetic: SIED6
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIADPASVPPLPDIWLPLNDSLEAITGYAPGYKTITIGSDEITVPVNGICQFSRASSATYIDKSGHITVAGNNVPRFEKYGLLIENQRTNMFVNSFNPDAWNKSGGISVTSSTDEFEFKYGRFTVGSDIAGTTTGRNICTVAGNRGIDVTGDDQYSKGPYVTASFRVRSDLNVRARIRFERYNSEGYTFLCDAYLSLQTHELQITGDNAQLLTANFEIDPGSGWIYFQATLKCLPEWGMVGTQLQIAADRAVGSFATGDWIEVTTPQFEYGACATSFIITTTEPATRASDLCKFPLMKNMYTMPFTFMVEVHKNWFIAHNAAPRVIDTENHQSGAPFIMGFGSSGTISQDGYPYCDIGGANRRVYESCGVRDLVMGFRVKADGMTCSFANKHISTETKTVWKYIREAAVIRIGGQTTTGLRHLNGHIKNLRFWNRALSDTQLKEYV

SEQ ID NO: 217 - protein, 89 aa, Artificial Sequence
  Synthetic: SIED6 AP1
MRDITLRFDNREQFNAIVYDSGLFSLEEENGILVDVIGRVIDYEEPENERCTGIDRGGFFVNMRIVDSSKNISSLMPFITTDQHVRTWA

SEQ ID NO: 218 - protein, 294 aa, Artificial Sequence
  Synthetic: SIED6 AP2
MVTKTVIPDDIKTLKSDVSKLKNDQGSYATKSYVDSKDETVGDWSASWYQQVLPTSGAIFGRKLRSTHRTAGVEDAYCELYLKKWIDSPGNAMARLNLNDNGENICWDFTNLYGGTMIFPGTSGYLKMGNCLMSYGVRGSNALIKFDNTDSLQIKYANHGSTMTLNTQGTAYSGVSTLLWGNSSRPVVYEIRDDGGLFLFYAQRNPDKTYQLEINGPCKATSFDQVSDRDLKENIRVIDNATERIRLMNGYTYRLKSNGMPYAGVIAQEALNAIPESVGSTIKYKSGDNGSDGE

SEQ ID NO: 219 - protein, 1096 aa, Artificial Sequence
  Synthetic: SIEA11
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAANDNANSRLAKNQNGADIQDKSAFLDNVGVTSLTFMKNNGEMPVDADLNTFGSVKAYSGIWSKATSTNATLEKNFPEDNAVGVLEVFTGGNFAGTQRYTTRDGNLYIRKLIGTWNGNDGPWGAWRHVQAVTRALSTTIDLNSLGGAEHLGLWRNSSSAIASFERHYPEQGGDAQGILEIFEGGLYGRTQRYTTRNGTMYIRGLTAKWDAENPQWEDWNQIGYQTSSTFYEDDLDDLMSPGIYSVTGKATHTPIQGQSGFLEVIRRKDGVYVLQRYTTTGTSAATKDRLYERVFLGGSFNAWGEWRQIYNSNSLPLELGIGGAVAKLTSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 220 - protein, 175 aa, Artificial Sequence; identical to SEQ ID NO: 32
  Synthetic: SIEA11 AP1

SEQ ID NO: 221 - protein, 835 aa, Artificial Sequence
  Synthetic: DC1
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAAYDLANGKYTAQDATTARKGLVQLSSVTNSDSETLAATPKAVKSAYDNAEKRLQKDQNGADIPGKDTFTKNIGACRAYSGALSTEAGNWTTAQFIDWLESQGAFNHPYWMCKCSWSYGNNKIITDTDCGTIHLAGCVIEVMGVKAAMTIRVTTPSTSSSGGTTSAQFTYINHGADYAPGWRRDYNTKNKQPAFALGKTGNTVANNKAVGWNWDSGAYCAQDGGASKMVLHFYTGEGSCPAMQFLVDYKNRGIFYRSARDGYGFEADWSEFYTTSRKPTPADILALALSGGSMSGSIKFINDAFLIWERNTDWAKIGFKNDSDADSDSYMWFETGDNGNEYFKWRIRSGSTTKDLMTLKSDALRVTGQVIPSNFSNFDSRYVRDIRLGGAATYKPANNGMTWTHQAPSGCVYTGIIVQDTGSNSADNIGGVYYRPVQKYINGTWYNVAQV

SEQ ID NO: 222 - protein, 175 aa, Artificial Sequence
  Synthetic: DC1 AP1
MQHLINITAGNPKTVEQYQLTKDFDVVWFFSEDGKNWYEEQKYFADDTIKIAYDKDNIIRYVEKDVTAIRPDGLSVVEVPDITANRRADISGGWMFKDGKVIKRIYTAEELQQQAENRKARLLADAESVILPLERAVRLNMATDEERSRLDAWERYSVLVSRVDPANPEWPEMPQ

SEQ ID NO: 223 - protein, 745 aa, Artificial Sequence
  Synthetic: EB6
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKIAMDNANARLAKDRNGADIPNKPLFIQNLGLQETVNKAGNAVQKTGDTLSGGLTFENDSILAWIRNTDWAKIGFKNDADSDTDSYMWFETGDNGNEYFKWRSRQSTTTKDLMNLKWDALYVLVNAIVNGEVISKSANGLRIAYGNYGFFIRNDGSNTYFMLTNSGDNMGTYNGLRPLWINNATGAVSMGRGLNVSGETLSDRFAINSSNGMWIQMRDNNAIFGKNIVNTDSAQALLRQNHADRKFMIGGLGNKQFGIYMINNSRTANGTDGQAYMDNNGNWLCGAQVIPGNYGNFDSRYVRDVRLGTRVVQLMARGGRYEKAGHAITGLRIIGEVDGDDEAIFRPIQKYINGTWYNVAQV

SEQ ID NO: 224 - protein, 175 aa, Artificial Sequence
  Synthetic: EB6 AP1
MQHLKNIKSGNPKTKEQYQLTKNFDVIWLWSEDGKNWYEEVNNFQDDTIKIVYDENNIIVAITKDASTLNPEGFSVVEIPDITANRRADDSGKWMFKDGAVVKRIYTADEQQQQAESQKAALLSEAENVIQPLERAVRLNMATDEERARLESWERYSVLVSRVDTAKPEWPQKPE

SEQ ID NO: 225 - protein, 1106 aa, Artificial Sequence
  Synthetic: AH11L
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAANDNANSRLAKNQNGADIQDKSVFLDNVGVTSLTFMKNNGEMPLDADLNTFGPVKAYLGIWSKATSTNATLEKNFPEDNAVGVLEVFAAGNFAGTQRFTTRDGNVYMRKLANKWNGTDGPWGVWRHTQSATRPLSTTIDLNTLGAAEHLGLWRNSSSAIASYERNYPEEGGFAQGTLEILEGGNYGRTQRYTTRRGNMYVRCLAASWDASNPQWEPWLRVGHQSESRYYEGDLNDVTSPGIYSVTGKATNGPVLDGNGVTVLGILEVLRRFDGVNVWQRYTTAGTGTTLKGRTFERVFTGSSWSEWREVYTSYSLPLNLGIGGAVAKLTSLDWQTYDFVPGSLITVRLDNMTNIPDGMDWGVIDGNLINIAVGPSDDSGTGRSMHVWRSTVSKANYRFFMVRISGNPGSRTITARRVPIIDEAQTWGAKQTFSAGLSGELSGNAATATKLKTARKINNVSFDGTSDINLTPKNIGAFASGKTGDTVANDKAVGWNWSSGAYNATTGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHIMRFVSGSIQSNKTINITGRVNPSDYGNFDSRYVRDIRLGGAATYKPANNGMTWTHQAPSGCVYSGIIVQDTGSNSADNIGGVYYRPVQKYINGTWYNVAQV

SEQ ID NO: 226 - protein, 175 aa, Artificial Sequence
  Synthetic: AH11L AP1
MQHLKNITAGNPKTVEQYQLTKGFDVVWFFSEDGKNWYEEQKYFADDTIKIAYDKDNIIRYVEKDVTAIRPDGLSVVEVADITANRRADISGGWMFKDGKVIKRIYTAEELLQQAENRKARLLADAESVILPLERAVRLNMATDEERSRLDAWERYSVLVSRVDPANPEWPEMPQ

SEQ ID NO: 227 - protein, 915 aa, Artificial Sequence
  Synthetic: STF-94A
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSAINSDSETLAATPKAVKTAYDLANRKYTAQDATTARKGLVQLSSATNSDSETLAATSKAVKSAYDNAEKRLQKDQNGADIPGKDTFTKNIGACRAYSGALSTEAGNWTTAQFIEWLDSRGAFNHPYWMCKGSWSYANNKIITDTGCGDIHLAGCVVEVMGTKSAITIRVTTPTTSSGGGTTSAQFTYINHGDGYSPGWRRDWNRQGDAMTGTINQDGGSQNAYMSTALCSGTRGGKKYLRKFRGGEGDTIWHETVQGGVVRWATGNTDAQEELSLSSAYGLRSRGEITSLSANGLRIAYGNYGFFIRNDGSSTYFMLTKSGDRLGTYNNLRPLIINDATGAVSMGHGLNVTGDIVSSTKVRAGSGKKFTVSSSNTSTKEAAFNLWGNSSRPVVAELGDDAGWHFYSQRNTDNSITFAVNGQVSPSNYGNFDSRYVRDIRLGGAATYKPANNGMTWTHQAPSGCVYSGIIVQDTGSNSADNIGGIYYRPVQKYINGTWYNVAQV

SEQ ID NO: 228 - protein, 175 aa, Artificial Sequence
  Synthetic: STF-94A AP1
MQHLINIMAGNPKTVEQYQLTKGFDVVWFFTEDGKNWYEEQKYFADDTIKIAYDKDNIIRYVEKDVTAIRPDGLSVVEVADITANRRADISGGWMFKDGKVIKRIYTAEELQQQAEIRKARLLADAESVILPLERAVRLNMATEEERTRLEAWERYSVLVSRVDPANPEWPEMPQ

SEQ ID NO: 229 - protein, 502 aa, Artificial Sequence
  Synthetic: STF-69A
ASATASANSQKAAKTSETNAKASETAAANSAKASAASQTAAKASEDAAREYASQAAEPYKYVLQPLPEVWIPFNDSLDMITGFAPGYKSITVGDDVIALPSEKVVSFTRASTATYIDKSGCFAESAINEPRFEKDGLLIEGQRTNTFSYTNTPVSWNYDTANLTITTGVDEYGFSYGLFGVKETSTTERATLISTGYTRVISVSANESVTLSCRVKKVSGDGIITLRPRISYVNDDGSSNTLTAGAYIDCETGDMLSYSGGEAATYNIFRESNGWIRVEFTYKSPEAKNMYGRFEFGAHQRSIKSGDKLMLTTPQFEKGLNASSFIITTEVGATRASDQVIIPIPFNWATPPVSVLMEVNVNWDSEMPNLEGSARLLNISITGATTEVSDESYMYFGFTTRGKRLIITNGKGTKTEYKAYGNREKRKFVTGFKFTEDKQLQVVVDGILGGSSPSLHTLQRYTAGNINIGGQSSSGNRHLFGHVKNLRIWHKELTEAQMGESI

SEQ ID NO: 230 - protein, 93 aa, Artificial Sequence
  Synthetic: STF-69A AP1
MKDLTLKFEDRADFSAFMESIGYYDDESMQDDILIDVIGNVYKETGELTEDGEPVCVKEDGYFVNVRIINDSQISSLFDEYVVAVEHQLRGWM

SEQ ID NO: 231 - protein, 346 aa, Artificial Sequence
  Synthetic: STF-69A AP2
MATSTVIPDDIKTLKSDVSKLKNDQGSYATKLYVDSKDEIVGDWSASWYQQVLPTSGAIFGRKLRSTHRTAGVEDAYCELYLKKWIDSPGNAMARLNLNDNGTNICWDFTNLYGGTMIFPGDSGYLKMGNCLMSYSKRGSNALIKFDYTDTLQIKYANHGSTMTLNTQGTAYAGVTAQLWGNSSRPVVYEVGVDGGAYMFYAQKNTDNTYMLSVNGACHATAFNQHSDRDLKDNIQVIDNATDRIRKMNGYTYTLKENGMPYAGVIAQEALEAIPEVVGSAMKYQDGASGSEGEEGERYYTVDYSGVTGLLVQVARESDDRITALEEENAELRQRLSAIEAALASK

SEQ ID NO: 232 - protein, 797 aa, Artificial Sequence
  Synthetic: STF-68B
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAKASAASQTAAKASEDAAREYASQAAEPYKQVLQPLPDVWIPFNDSLEMITGFAPGYKKVTIGDDVITFPSEKVVSFTRSTSATYINKSGSFAFAEINEPRFEKEGLLIEGQRTNTFTNSNNPSLWNYDDKNIEITTSVDEYGFKYGLFDVKETSTTERATIISTGYSRVIDVAANESVTLSCRVKKINGEGIITLRPRISFVNDDGTSNTLVAGSYIDCETGDVLGFSGGDAVNHVIYREANGWLRVEFTYKSPEAKSMYGRFEMGADKRAIKKGDQIMFTTPQFEKGSCASSFIVTSDVAVTRASDVVIMPIRLNWSTPPLSVLMEVNINWDKMPNSEGSARLLNVSITGATTDVADESYMYFGFTSGGARSIITNGKGTKTEYKAYCNRTTRRFIAGFKFTEQKELRAVINGNFGAVDVSQHTRQRYTEGPINIGGQSISGNRHLFGHVRNLRIWHKELTDAQMGERI

SEQ ID NO: 233 - protein, 93 aa, Artificial Sequence
  Synthetic: STF-68B AP1
MRDLTLKFINKADFSAFMDSIGYEDDEVMQNNVLIDVIGNVYKETGELTEDGEPVCVKEDGYFVNVRIINDAKKSSIFDKYAVVVEHQLRGWM

SEQ ID NO: 234 - protein, 346 aa, Artificial Sequence
  Synthetic: STF-68B AP2
MATSTVIPDDIKTLKSDVSKLKNDQGSYATKSYVDSKDETVGDWSASWYQQVLPTSGAIFGRKLRSTHRTAGVEDAYCELYLKKWIDSPGNAMARLNLNDNGTNICWDFTNLYGGTMIFPGDSGYLKMGNCLMSYSKRGSNALIKFDYTDTLQIKYANHGSTMTLNTQGTAHAGVTTRLWGNSSRPVVYEVGVDEALYMFYAQKTTSNTYELTVNGACNASAFNQGSDRDLKDNIQVIDNATDRIRKMNGYTYTLKENGMPYAGVIAQETLEAIPEAVGAMMKYPDGGSGLDGEEGERYYTVDYSGVTGLLVQVARESDDRITALEEENAELRQRLSAIEAALASK

SEQ ID NO: 235 - protein, 824 aa, Artificial Sequence
  Synthetic: STF-118
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTARQGTNNTQIANTAFVMAAIAALVDSSPDALNTLNELAAALGNDPNFATTMTNALAGKQPKDATLAALAGLATAADRFPYFTGNDVASLATLTKVGRDILAKSTVSAVIEYLGLQETVNRAGNAVQKNGDTLSGGLTFENDSILAWIRNTDWAKIGFKNDADGDTDSYMWFETGDNGNEYFKWRSRQSTTTKDLMNLKWDALYVLVKALFSSEVKISTVNALRIFNSSFGAIFRRSEENLYIIPTRENEGENGDIGPLRPFGINLRTGVVSVGNGARIDGGLALGTNNALGGNSIVLGDNDTGFKQNGDGNLDVYANNVHVMRFVSGSIQSNKTINITGRVNPSDYGNFDSRYVRDIRLGTRVVQTMQKGVMYEKAGHVITGLGIVGEVDGDDPAVFRPIQKYINGTWYNVAQV

SEQ ID NO: 236 - protein, 175 aa, Artificial Sequence
  Synthetic: STF-118 AP1
MQHLKNITAGNPKTVAQYQLTKNFDVIWLWSEEGKNWYEEVSNFQEDTIKIVYDENNIIVGITRDASTLNPEGFSVVEVPDITSNRRADDSGKWMFKDGAVIKRIYTADEQEQQAESQKAALLSEAESVILPLERAVRLNMATDEERSRLEAWERYSVLVSRVDPANPEWPEMPQ

SEQ ID NO: 237 - protein, 879 aa, Artificial Sequence
  Synthetic: STF-90B
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSVTNSDSETLAATPKAVKTAYDLANGKYTAQDATTARKGLVQLSSATNSDSETLAATPKAVKSAYDNAEKRLQKDQNGADIPGKDTFTKNIGACRAYSGALSTDAGNWTTAQFIDWLESQGAFNHPYWMCKCSWSYGNNKIITDTDCGTIHLAGCVIEVMGVKAAMTIRVTTPSTSSGGGTTSAQFTYINHGADYAPGWRRDYNTKNKQPAFALGKTGNTVANNKAVGWNWDSGAYCAQDGGASKMVLHFYTGEGSCPAMQFLVDYKNRGIFYRSARDGYGFEADWSEFYTTSRKPTPADILALALSGGSMSGSIKFINDAFLIWERNTDWAKIGFKNDSDADSDSYMWFETGDNGNEYFKWRIRSGSTTKDLMTLKSDALRVTGQVIPSNFSNFDSRYVRDIRLGGAATYKPANNGMTWTHQAPSGCVYTGIIVQDTGSNSADNIGGVYYRPVQKYINGTWYNVAQV

SEQ ID NO: 238 - protein, 175 aa, Artificial Sequence
  Synthetic: STF-90B AP1
MQHLKNITAGNPKTVEQYQLTKDFDVVWFFSEDGKNWYEEQKYFADDTIKIAYDKDNIIRYVEKDVTAIRPDGLSVVEVADITANRRADISGNWMFKDGTVIKRIYTAEELQQQAENRKARLLADAESVILPLERAVRLNMATEEERSRLERWERYSVLVSRVDPANPEWPEMPQ

SEQ ID NO: 239 - protein, 871 aa, Artificial Sequence
  Synthetic: STF-117
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSATNSDSETLAATPKAVKSAYDNAEKRLQKDQNGADIPGKDTFTKNIGACRAYSGALSTEAGNWTTAQFIEWLDSRGAFNHPYWMCKGSWSYANNKIITDTGCGDIHLAGCVVEVMGTKSAITIRVTTPTTSSGGGTTSAQFTYINHGDGYSPGWRRDWNRQGDAMTGTINQDGGSQNAYMSTALCSGTRGGKKYLRKFRGGEGDTIWHETVQGGVVRWATGNTDAQEELSLSSAYGLRSRGEITSSSANGLRIAYGNYGFFIRNDGSSTYFMLTKSGDRLGTYNNLRPLIINDATGAVSMGHGLSVTGDIASSTKVRAGSGKKFTVSSSNTSTKEAAFNLWGNSSRPVVAELGDDAGWHFYSQRNTDNSITFAVNGQVSPSNYSNFDSRYVRDIRLGGAATYKPANNGMTWTHQAPSGCVYSGIIVQDTGSNSADNIGGVYYRPVQKYINGTWYNVAQV

SEQ ID NO: 240 - protein, 175 aa, Artificial Sequence
  Synthetic: STF-117 AP1
MQHLINITAGNPKTVEQYQLTKDFDVVWFFTEDGKNWYEEQKYFADDTIKIAYDKDNIIRYVEKDVTAIRPDGLSVVEVADITANRRADISGNWMFKDGKVIKRIYTAEELQQQAENRKARLLADAESVILPLERAVRLNMATDEERSRLEAWERYSVLVSRVDPANPEWPEMPQ

SEQ ID NO: 241 - protein, 798 aa, Artificial Sequence
  Synthetic: STF-66D
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATAAANSQKAAKTSETNSKASETAAANSAKASAASQTAAKASEDAAREYASQAAEPYKQVLQPLPDVWIPFNDSLDMITGFSPSYKKIVIGDDEITMPGDKVVKFKRASKATYINKSGVLTEAAIDEPRFERDGLLIEGQRTNYMLNSENPASWGRSSNMDVPETGTDSFGFTYGKFVCNDSLIGQTSAINMASIAATKSVDVSGDNKYVTTSCRFKTELQVRLRIRFDKYDGSATTFLGDAYIDTQTLEINMTGGASGRITARVRKDETTGWIFAEATIQAIDGELKIGSQIQYSPKQGGATVSGDYIYLATPQVENGACVSSFIISGTTAATRASDMVTIPTENNIYNRPLTCLVEVNRNWGDIPPNVAPRIFDFSGVPPIESITYAFNTTEKYYGQLYMQTYKASTSSYVSSLFTGRTDVRKLIGGFNIYSDGTKRVVSNGEATKTMKTEWTGVKTRTFIRIGGQATSGTRHLFGHLRNLRLWHKELTDAQMGESIK

SEQ ID NO: 242 - protein, 93 aa, Artificial Sequence
  Synthetic: STF-66D AP1
MKDLTLKFADRADFSAFMESIGYYDDESMQDDILIDVIGNVYKETGELTEDGEPVCVKEDGYFVNVRIINDSQISSLFDEYVVAVEHQLRGWM

SEQ ID NO: 243 - DNA, 2517 bp, Artificial Sequence
  Synthetic: O111
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggcatcaggtgcattacagaagaatcaaaacggtgcagacattccgggcaaagatacctttaccaagaatatcggtgcttgtcgtgcttattcggcatggcttaatatcggaggtgattctcaggtatggactacggctcagtttatctcttggctcgagagtcagggtgcgtttaatcatccgtactggatgtgcaaaggctcttgggcgtacgcgaacaacaaagtcatcaccgacactggttgtggtaacatctgtctggcgggtgcagtagtggaagttatcggtacgcgcggtgcgatgacgatccgtgtaactactccatctacctcctccggtggcggtatcaccaacgcccagttcacttacattaaccacggcgatgcctatgctccgggctggcgccgtgattacaacactaaaaaccaacaacctgcgtttgcactgggtcagacgggtagtcgtgtggcgaacgataaagcggtcggttggaattggaactctggtgtgtacaacgctgatattagtggagcttctactctgatccttcattttaacatgaatgctggaagttgtccggcagtgcagtttcgtgttaactatcgtaatggaggaatcttttaccgctctgcacgtgacggctacggcttcgaagcgaactggagtgaattttacacgaccactcgtaagccgagtgctggagatgtgggagcttatactcaggcagaatgcaattcgcgtttcattactggtattcgtctgggaggtttaagttccgtgcagacttggaacggtccaggttggagtgatcgtagtggctatgttgtgacaggcagtgttaacggcaaccgtgacgaactgatcgacactactcaagcgcgtccgatccagtactgcattaacggaacttggtataacgcgggaagtatctaa

SEQ ID NO: 244 - DNA, 2376 bp, Artificial Sequence
  Synthetic: SIED6
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagctgatcctgcttctgtccctccgcttcctgatatctggctacccttgaatgattctctggaagcgataacagggtatgcgccggggtataaaacaataaccatcggcagcgatgaaatcactgtgccagttaatggcatatgccaatttagccgggcttcatctgcaacgtatattgataagtccgggcatattaccgtggcagggaataacgttcctcgttttgaaaaatatggtttgctgatagagaatcagcgaacaaacatgttcgtaaatagttttaatcctgatgcgtggaataaaagcggtggtatatctgtaacatcatcaacagatgaatttgagtttaaatatggacgtttcacagtaggaagcgacatagcaggaacgacaacagggagaaatatatgcacagttgctggtaatagaggcatagatgtgactggcgatgatcagtacagtaaaggtccgtatgttaccgcgtcgttcagggtaagaagtgatctcaatgttcgcgcacgtatccgttttgaacggtataactcggaaggatacactttcctttgtgacgcctatttgtcattacagacccatgaactacaaattacgggtgataatgcccagctattaacagcaaactttgaaatcgatccaggtagtggatggatatattttcaggcaaccctgaaatgtctgccagaatggggaatggttggtacgcagttgcaaattgcagccgacagagctgtggggtcttttgcaacaggtgactggatagaagtaaccaccccgcaatttgagtatggtgcttgtgcaacttcctttatcataacgacaacagagccagcgactcgtgcatcagatttatgtaaatttccgctgatgaaaaatatgtataccatgccttttacgttcatggtggaagtccataaaaactggtttattgctcataatgctgcaccgcgagtaattgatacagaaaaccatcagtcaggtgctccatttatcatgggatttggctcttctggaactatcagtcaggacggttatccctattgtgatataggcggggctaaccgacgtgtatatgagtcatgcggagtaagagatcttgttatgggattcagggttaaggctgacggcatgacatgctcatttgcaaataagcatataagcacagaaacaaaaacagtatggaaatatattcgtgaagctgctgtgattcgtatcgggggacaaacgacgacaggattacgacaccttaatggtcatataaaaaacctccgtttctggaacagagcattgtcagatacgcagcttaaggaatacgtataa

SEQ ID NO: 245 - DNA, 270 bp, Artificial Sequence
  Synthetic: SIED6 AP1
atgcgggatataacattacgattcgataacagagaacagtttaacgcaattgtatatgacagtggcctgttcagtcttgaagaagaaaacgggattcttgttgatgttattggccgcgttatcgattacgaggagccagaaaacgaaagatgtacaggcattgatcgcggcggttttttcgtaaacatgaggattgttgatagcagtaaaaacatatcttctttaatgcctttcattacgacagatcagcatgtaaggacatgggcttaa

SEQ ID NO: 246 - DNA, 885 bp, Artificial Sequence
  Synthetic: SIED6 AP2
atggttacaaaaacagtaattcctgatgacatcaaaacgctaaaatccgatgttagtaaactaaaaaacgatcaaggaagctacgcaacaaaatcatatgtagacagcaaagatgaaaccgttggtgactggtctgcttcatggtatcagcaggtattgccaactagcggagctatatttgggagaaaactccgctcaactcaccggacggcaggtgttgaggatgcgtattgcgaactataccttaaaaaatggatagacagcccagggaacgcaatggcgcgccttaacctgaacgataacggtgaaaatatttgctgggattttaccaacctttacggcggaacaatgatcttccctggaacttcaggctatctgaaaatggggaactgtctcatgtcgtatggtgtgcggggaagtaacgcgcttattaagtttgataatacagactcattgcagatcaaatatgctaatcacgggtcgaccatgacactaaacacgcaaggcacggcgtattctggtgtgtcgacgttattatggggaaattccagtcgtccagttgtttatgagattagggatgatggcgggctttttttgttttatgcacaaaggaacccagataaaacctatcagcttgagataaacgggccatgtaaggctacatcattcgaccaggtgtcggacagagatcttaaagaaaacattcgggttattgataatgccactgaacgcatcagattaatgaatgggtatacttaccgtctcaagtctaatggtatgccttatgctggcgttattgcgcaagaggcacttaatgcaatccctgaatcagttggtagcacaataaagtacaagagcggggacaatgggtctgatggagaatag

SEQ ID NO: 247 - DNA, 3291 bp, Artificial Sequence
  Synthetic: SIEA11
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcaaatgacaacgcaaattcacgtctggcgaaaaatcagaatggtgcagatatccaggataaatcagcttttctggacaatgttggcgttaccagcctgacgtttatgaaaaacaatggcgaaatgccggttgatgctgatctgaatacgtttggttctgttaaggcttattcaggtatctggtctaaagcaacgtccaccaacgcaacactggagaaaaacttccctgaagataatgctgtcggtgtgcttgaggtttttactggcggcaattttgcaggcacgcaacgctataccacacgtgacggaaatttgtatatccgcaaactcattggaacatggaatggtaatgatggaccatggggagcatggcgccatgttcaggctgtaacgcgagctctaagtacgaccattgaccttaactctctcggtggcgcagaacatttaggtctatggagaaacagcagttcagcaatagcttcttttgaacgacattaccccgagcagggaggagacgcgcagggcattctggaaattttcgaaggtgggctatatggacgcacacagcgttatacaacccgtaacgggactatgtatattcgcggcctgacagccaaatgggatgcagaaaatccacagtgggaagactggaaccaaattggttatcagaccagtagtaccttctatgaggatgacctggatgatttgatgtctccaggtatttacagtgtgacaggcaaagcgacccacaccccaatccaggggcagtctggttttctggaagtcatcaggcgcaaggatggtgtctatgttttgcaacgttacacgaccacaggaaccagcgcagctacaaaagaccgtttatatgagcgagtgtttcttggtggctcatttaacgcgtggggggagtggcgacagatttataactcaaactctttgccgttagagttgggtatcggtggcgcagtggcaaaactcaccagcctggactggcagacatacgattttgtgccgggcagtctgataaccgttcggctggataacatgaccaatattcccgacggtatggactggggcgtcattgatggcaacctgataaacatctcagtcggtccgagtgatgattctggttcgggacgctcaatgcatgtatggcgcagcactgtaagtaaagccaactaccgcttttttatggtgcgtatttcaggaaatccgggaagccgcacgatcacgacaagacgtgtgccaattatcgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactattggtggggcatcaacgttaattcttcattttaatatcggggaaggaagttgtcccgccgcccagtttcgcgttaattataagaacggtggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtgtaa

SEQ ID NO: 248 - DNA, 528 bp, Artificial Sequence; identical to SEQ ID NO: 92
  Synthetic: SIEA11  AP1

SEQ ID NO: 249 - DNA, 2505 bp, Artificial Sequence
  Synthetic: DC1
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcatatgaccttgctaacgggaaatacactgcacaggacgccaccacagcgcgaaaaggtcttgtccagctcagtagcgtcaccaacagtgattctgaaaccctcgcggcaacgccaaaagcagtgaagtctgcctatgacaatgctgaaaaacgtcttcagaaagatcagaacggtgcggatattccgggaaaggataccttcacgaaaaatatcggtgcctgtcgtgcttatagcggcgctttgagcactgaagccggaaactggacaaccgcgcagtttattgactggctagagtctcagggagcctttaatcatccctactggatgtgcaagtgttcctggtcatacggtaataacaaaattattaccgatactgactgtgggacgattcatcttgcaggttgcgtgattgaggttatgggtgttaaagcagcaatgaccattcgtgtgaccactccgagtacatcaagcagtggtggtaccaccagtgcgcaattcacgtatatcaatcacggagctgattatgcgccgggctggcgacgcgactacaatacgaaaaataagcaaccggcttttgcattagggaaaacaggaaatacggttgcaaataataaagcagtaggatggaactgggacagtggtgcttattgtgcacaggatggcggagcatcaaaaatggtgctgcatttttacacgggtgagggaagttgtccggcaatgcagtttcttgtggattataaaaacagggggattttttacaggtcggcacgtgatgggtatggatttgaggctgactggtcagagttttataccacatcacgaaagccaacacctgcggatattcttgctctggcattatcaggcggaagcatgtcaggcagcataaaatttatcaatgatgccttcctgatttgggaaagaaacactgactgggcgaaaattggatttaaaaatgattcagatgctgattctgactcatacatgtggtttgaaactggtgataatggcaatgaatattttaaatggcgcatcaggtctggcagcacaacaaaagacctgatgacgcttaagtctgatgcactacgggttaccgggcaggtgataccatcaaatttcagcaattttgactcccgctatgtccgggatatccggcttggtggtgccgccacatacaaacctgcgaacaatggcatgacatggacacatcaggcaccgtccgggtgtgtatataccggcattattgttcaggataccggctcaaactctgccgataacattggtggcgtatattacagaccggttcagaaatacattaacgggacgtggtacaacgtggcgcaggta

SEQ ID NO: 250 - DNA, 528 bp, Artificial Sequence
  Synthetic: DC1 AP1
atgcagcatttgataaatataacggcaggtaatccaaaaacggttgaacaatatcaattgacaaaggactttgatgttgtctggtttttttcagaagatggtaagaactggtacgaagaacaaaagtattttgctgatgacacgataaaaatagcgtacgacaaagataatattatccgctatgtggaaaaggatgtgacagctatcagaccagatggattaagtgttgttgaagtgccggatattactgctaatcgacgggcggacatttcagggggctggatgtttaaggacggcaaagtgattaaacgcatttatacggcagaggaattgcagcagcaggcagaaaaccggaaagccagacttcttgcagatgctgaatccgtgattttgccgctggagcgcgcggtcagactgaacatggcaacagatgaggagcgtagccgactggatgcatgggagcgttacagcgttctggtcagtcgtgtggatcctgcaaatcctgaatggccggaaatgccgcaataa

SEQ ID NO: 251 - DNA, 2238 bp, Artificial Sequence
  Synthetic: EB6
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaagattgcgatggataatgccaatgcccgtctggcaaaagaccggaacggagcagatattcccaataagccgctgtttatccaaaacctcggtttacaggaaacggtaaacaaggctggtaacgccgttcaaaagacaggcgataccttgtccggcggacttacttttgaaaacgactcaatccttgcctggattcggaatactgactgggcaaagattggatttaaaaatgatgccgacagcgacactgattcatacatgtggtttgaaacaggcgacaacggcaatgaatatttcaaatggagaagccgccagagcaccacaacaaaagacctgatgaatcttaaatgggatgctttgtatgttcttgtcaatgccattgtaaatggcgaagtcatatcaaaatcagcaaacggcctacgtattgcttatggtaattacggattctttattcgtaatgatggttcaaatacatacttcatgttgacaaactccggtgacaacatggggacttataacggattaaggccattatggattaataacgctactggcgctgtttcgatggggcgtggtcttaatgtttcaggggagacactttcagaccgttttgctattaacagcagtaatggtatgtggattcagatgcgcgataacaacgctatctttgggaaaaatatagttaacactgatagcgctcaggcgttacttcgccagaatcacgccgaccgaaagttcatgataggtggactggggaacaagcaatttggcatctacatgattaataactcaaggacagccaatggcaccgatggtcaggcgtacatggataataacggtaactggctttgtggtgcgcaagttattcccggcaattatggcaattttgactcacgctatgtgagagatgtccgacttggcacacgtgttgttcaattgatggcgcgtggtggtcgttatgaaaaagccggacacgcaattaccggattaagaatcattggtgaagtagatggcgatgatgaagccatcttcaggccaatacaaaaatacatcaatggcacatggtataacgtcgcacaggtgtaa

SEQ ID NO: 252 - DNA, 528 bp, Artificial Sequence
  Synthetic: EB6 AP1
atgcagcatttaaaaaatattaagtctggaaatcctaaaacgaaagaacaatatcagctaacaaagaattttgatgttatctggttatggtccgaagacggtaaaaactggtatgaagaagtaaataactttcaggacgacaccataaagattgtatacgacgaaaataatattattgttgccataaccaaagatgcctcaacgcttaatcccgaaggctttagcgtcgttgagattccagatataacagccaatcgtcgtgccgatgattcagggaagtggatgtttaaggacggagctgtggttaaacggatttatacggcagacgagcaacaacaacaggccgaatcacaaaaggccgcgttactttccgaagcagaaaacgttattcagccactggaacgcgctgtcagactgaatatggcgacggatgaggaacgcgcacgactggagtcatgggaacgctacagtgttctggtcagccgtgtggatacggcaaagccagaatggccacaaaagcctgaataa

SEQ ID NO: 253 - DNA, 3321 bp, Artificial Sequence
  Synthetic: AH11L
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcaaatgacaacgcaaattcacgtctggcgaaaaatcagaacggtgcagatatccaggataaatcagtttttctggacaatgttggcgttaccagcctgacgtttatgaaaaacaatggcgaaatgccgcttgatgctgatctgaatacatttggtcccgttaaggcttatctggggatctggtctaaagctacctcaactaacgcaacactggagaaaaatttcccggaagataatgctgtcggtgtgcttgaggtttttgctgccggcaattttgcaggtacgcaacgctttaccacaagagacggcaatgtatacatgcgtaaactcgccaataagtggaatggcactgatggtccgtggggcgtatggcgtcacactcaatcagctacccgccctttgagtacgactatagacctgaatacgcttggagccgccgaacatcttggtttatggcgtaacagtagctcggctatagcttcatatgaacgcaattatccagaggaaggcggctttgctcaggggacgcttgagatcctcgaaggcgggaattatggaagaacgcaacgttataccactcgccgtggaaatatgtatgtccgctgccttgcggcaagctgggatgcatcaaatccgcagtgggaaccgtggttaagagtcggtcatcagtcagagagtcgttattacgaaggtgatttgaatgatgtaacctcaccaggtatttacagcgttacaggtaaagcgaccaacggtccagtactggacggaaacggcgtgactgtactcggcattctggaagtgttgaggcggtttgatggtgttaatgtatggcagcgttatacaactgccggaacaggtacaacccttaaaggccgcacctttgagcgcgtctttaccggcagctcatggagcgaatggcgggaagtctacacctcgtattcacttcccctgaatctgggtatcggcggtgctgtggcaaagctcaccagcctggactggcagacctacgattttgtgccgggcagtctgataaccgttaggctggataatatgaccaatattcccgacggtatggactggggcgtcattgatggcaacctgataaacatcgcagttggtccgagtgatgattccggtacggggcgctcaatgcatgtatggcgcagcactgtaagtaaagcgaactaccgattttttatggtgcgtatttcaggaaatccgggaagccgcacgatcacagcaagacgagtaccaatcattgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttgggtggaactggagtagcggagcctataacgcaactactggtggggcatcaacgttaattcttcattttaatatcggtgaaggaagttgtcccgccgcccagttccgcgttaattataagaacggcggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatattatgcgctttgtctcgggaagtattcaaagtaataaaaccataaatattacggggcgtgttaatccctcggattacggtaactttgattcccgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggtgtatattacaggccggttcagaaatacattaacgggacatggtataacgtggcgcaggtataa

SEQ ID NO: 254 - DNA, 528 bp, Artificial Sequence
  Synthetic: AH11L AP1
atgcagcatttgaaaaatattacggcgggtaatccaaaaacggttgaacaatatcaattgacaaagggttttgatgttgtctggtttttttcagaagatggtaagaactggtacgaagaacaaaagtattttgctgatgacacgataaaaatagcgtacgacaaagataatattatccgctatgtggaaaaggatgtgacagctatcagaccggatggattaagtgttgttgaagtggcggatattactgctaaccgacgggcggacatttcagggggctggatgtttaaggacggcaaagtgattaaacgcatttatacggcagaggaattgctgcagcaggcagaaaaccggaaagccagacttcttgcagatgctgaatccgtgattttgccgctggagcgcgcggtcagactgaacatggcaacagatgaggagcgtagccgactggatgcatgggagcgttacagcgttctggtcagtcgtgtggatcctgcaaatcctgaatggccggaaatgccgcaataa

SEQ ID NO: 255 - DNA, 2748 bp, Artificial Sequence
  Synthetic: STF-94A
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatataccgcacaggacgccaccacagcgcgaaaaggccttgttcagctgagtagcgccatcaacagcgattctgaaacgcttgcggcaacgccaaaggcggttaagacagcgtatgaccttgctaacaggaaatacactgcacaggatgccaccacagcgcgaaaaggtcttgtccagctaagtagcgccaccaacagtgattctgaaacgctggccgcaacatcaaaagcggtgaagtctgcctatgacaatgctgaaaaacgtcttcagaaagatcagaatggtgcggatattccgggaaaggataccttcacgaaaaatatcggtgcctgtcgtgcttatagcggcgctttgagcactgaagccggaaactggacaaccgctcagtttattgaatggctggattcccgtggtgcatttaatcatccgtactggatgtgcaaaggctcctggtcatatgcaaataacaaaatcattacggataccggatgtggtgatatccacctggctggttgtgtcgtcgaggtcatgggaactaaatctgcaatcactatccgagtgaccacaccgacaacatcaagcggtggcggtacaaccagcgcacaattcacttacattaatcatggggacggctactcccccggctggcgtcgtgactggaatcgtcagggcgacgcaatgaccggaacgattaatcaggacggtggaagccagaatgcctatatgtctacggccttatgttcaggcacaagaggcggcaaaaaatatctcagaaagtttcgtggtggagaaggagacactatctggcatgaaacagtacagggcggggtagttcgttgggcgactggtaatactgatgctcaggaagaattatcactcagctccgcttatggtctccgttcaagaggtgagattacatcactcagtgctaatggtctgcgcattgcttatggcaattatggtttctttatcaggaatgatggcagcagcacttattttatgttgactaaatcaggtgacagattaggaacttataataatttaagaccgctgattataaatgatgccactggtgctgtatcaatggggcatggcctgaatgttactggtgatattgtctcaagtaccaaagtacgtgccggtagcgggaaaaaattcacggtcagcagcagtaatacatccacgaaggaagccgcattcaatttgtggggaaactcaagtcgtccggtggtggctgaattaggtgatgatgcaggctggcatttttacagtcagagaaatacagataacagcatcacttttgctgttaacgggcaggtatcaccatctaactatggcaactttgattcacgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggcatatattacagaccggtgcagaaatacattaacgggacatggtataacgtagcgcaggtataa

SEQ ID NO: 256 - DNA, 528 bp, Artificial Sequence
  Synthetic: STF94A AP1
atgcagcatttgataaatataatggcgggtaatccaaaaacagttgaacaatatcaattgacaaagggctttgatgttgtctggttttttacagaagatggtaagaactggtacgaagaacaaaagtattttgctgatgacacgataaaaatagcgtacgacaaagataatatcatccgctatgtggaaaaggatgtgacagctatcagaccggatggattaagtgtggttgaagtggcggatattactgctaaccgacgggcggatatttcagggggctggatgtttaaggacggcaaagtgattaaacgcatttatacggcggaggaattacagcagcaggcagaaattcggaaagccagacttcttgcagatgctgaatccgtgattttgccgctggagcgcgcggtcagactgaacatggcaacagaggaggagcgcacacggctggaggcttgggaacgctacagcgttctggtcagtcgtgtggatcctgcaaatcctgaatggccggaaatgccgcaataa

SEQ ID NO: 257 - DNA, 1509 bp, Artificial Sequence
  Synthetic: STF-69A
gcttctgccactgcatcagctaacagtcaaaaagcagcaaaaaccagtgaaaccaacgcaaaggcgagcgaaacagcggctgcgaactcagcgaaagcatcggcagcaagccagacggcagctaaagcaagcgaagatgcagccagagagtacgcaagccaggctgcggagccgtataaatatgtcttacagccgttacctgaggtgtggataccgtttaacgattcactggatatgattaccgggtttgctcctggatataagagcatcacagttggtgacgatgttattgcattgccgtctgaaaaggttgtttcatttaccagggcgtcaactgcaacgtatatagataagtctgggtgttttgctgaatcagcgataaatgaaccacgttttgaaaaagatggtctgctcattgaaggtcagagaacgaatactttttcttatacgaatacaccagtatcgtggaactatgacactgctaacttaactattaccacgggagttgatgagtatggtttcagttatggtttgtttggcgttaaagaaacatccacaactgaaagggcgacattaatttctactggatataccagggttatttcagtttcggcaaatgaatcagttactttatcctgcagagttaaaaaagtaagtggggatggtattatcacgttgcgtccaagaatatcatatgttaacgacgatggctcaagtaacacactgaccgctggcgcatatattgattgcgagactggcgatatgttgagttattctggaggtgaggcggcaacttataacatattcagagagtctaatggatggattcgtgttgagtttacctacaaatcaccagaagcaaaaaatatgtatgggcgttttgagtttggagcacatcaacgatcaatcaagtctggcgataaattaatgttaacaacccctcaattcgaaaagggactaaacgcgtcatcttttatcatcacaacagaggtcggtgccacgagagcaagtgaccaggtaatcatacctatacctttcaattgggcaactccaccagttagtgttctcatggaagttaatgttaattgggattctgaaatgcctaatttagaaggctctgcgcgtttgcttaatatctcaattacaggggcgacgactgaagtttctgatgaaagttatatgtattttggttttaccactcgtggtaaaaggctaattatcaccaatggcaaaggaacaaaaacagaatataaagcatatgggaatagagagaaaaggaaatttgttactggctttaagtttacagaagataaacagttgcaggttgttgttgatggaattttaggtggcagctccccgtctctgcatacattgcaacgttatactgccggtaatattaatatcggtggacaatcatccagtggcaacagacacctgttcggtcatgtgaaaaatttacgcatttggcataaagaattaactgaggcacaaatgggggagtcaatctaa

SEQ ID NO: 258 - DNA, 282 bp, Artificial Sequence
  Synthetic: STF69A AP1
atgaaagatttaacactcaaatttgaagacagggccgacttttcggcctttatggagagtattggctattatgatgacgagtcgatgcaggatgatattcttatcgacgtgataggtaacgtgtacaaagaaaccggagaactgactgaagatggcgaaccggtatgtgttaaggaagacggatattttgtaaacgtgcgcatcattaatgattcgcaaatatcgtcattattcgatgaatacgtggttgctgttgagcatcaacttcgtggctggatgtga

SEQ ID NO: 259 - DNA, 1041 bp, Artificial Sequence
  Synthetic: STF69A AP2
atggctacatcgacagtaattcctgatgacatcaaaacgctaaaatccgacgttagcaaattaaaaaacgatcaaggaagctacgcaacaaaattatatgtagacagcaaagatgaaatcgttggtgactggtctgcttcatggtatcagcaggtattgccaactagcggagctatatttgggagaaaactccgctcaactcacaggacggcaggtgttgaggatgcgtattgcgaactatacctcaaaaaatggatagacagtccaggtaacgcaatggcgcgccttaacctgaacgataacgggacaaacatttgctgggactttaccaacctttatggcggtacgatgatttttcccggtgacagcggatacctcaaaatgggtaactgccttatgtcatacagcaagcgtggaagtaacgcgcttattaaatttgattacaccgacacattacagatcaaatatgccaatcatgggtcaaccatgacattaaacacacagggaaccgcttatgctggtgttactgctcaattgtggggcaactccagccgtcctgttgtttatgaagtcggtgttgatggtggcgcttatatgttctatgcgcagaaaaataccgataacacctatatgttaagcgttaatggtgcatgtcatgccaccgcatttaaccagcattccgaccgggatctgaaagacaacattcaggtgatcgataatgcaaccgaccgcatccgtaaaatgaacggctatacatacacgcttaaagaaaacggtatgccctatgctggtgtcattgcacaggaagctctggaagcaatcccagaagttgtaggttccgcaatgaaatatcaggacggtgcgagcggatcggaaggtgaagaaggtgaacgttattacacagtagattattctggtgttactggcttgcttgttcaggtagccagagagtcagacgacagaataacagcactggaagaagaaaacgcagaattaagacaaagattatctgcaattgaggcggcgcttgcgtctaaataa

SEQ ID NO: 260 - DNA, 2394 bp, Artificial Sequence
  Synthetic: STF-68B
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatctgccaacagtcaaaaagctgcaaagacgagcgaaaccaacgcaaagacaagcgagactgcggcggctaactcggcgaaagcatcagctgcaagccagacggctgcaaaagcgagtgaagacgcagccagagagtatgcaagccaggctgcggagccgtataaacaagttttgcagccgcttcccgatgtgtggataccgtttaacgattcactggaaatgattactggtttcgctcctggttataaaaaagtaactatcggtgatgatgttattacttttccatcagagaaggttgtatctttcactcgctccacttctgcaacgtatataaacaaatcaggttcatttgcttttgcagaaattaacgagccgcgctttgaaaaggaaggtttattaattgaaggtcagaggacaaatacatttactaatagtaacaatccttcattatggaattatgacgacaagaatatagaaataaccacatcggttgatgaatatggttttaaatatggtttgttcgatgtaaaggaaacatcaactactgaaagggcgacgataatatctactggatacagtagggttattgatgttgctgcaaatgaatctgttactttgtcctgtagggttaagaagataaatggagaaggtattataacgttaagacccagaatatctttcgttaacgatgacggtacaagcaacacgctggtagctggttcctacatagattgcgaaactggtgatgttttaggtttttctggtggggatgctgtaaatcatgtcatatacagagaagctaacggatggttacgcgtcgaatttacatataaatcaccagaagcaaaaagcatgtatgggcgctttgaaatgggagcagataaaagggcgatcaaaaaaggcgatcagataatgtttactacgccgcaatttgaaaaaggatcgtgtgcatcatcatttatcgttacatcagatgtggcagttacacgggctagtgacgtggtaataatgccaataagactgaactggtcaacacctccgttaagcgttcttatggaagttaatatcaactgggacaaaatgccaaacagtgaaggttcagcaaggcttcttaacgtgtcaataactggcgcaacaacggatgttgctgatgaaagttatatgtattttggttttacctctggaggcgcgcgctcaattataactaacggaaaaggaacaaagaccgagtataaagcctactgtaacaggacaacccgcaggtttattgctgggtttaagtttacagagcagaaagaattgcgtgctgttataaacggtaactttggcgctgttgatgtatcacaacacacaagacaacgttatacagaagggccaataaatataggcggtcaatcaatatcaggtaacaggcatttatttggacacgtgcgcaatttacgtatctggcataaggaactgacagatgcacaaatgggagaaagaatataa

SEQ ID NO: 261 - DNA, 282 bp, Artificial Sequence
  Synthetic: STF68B AP1
atgcgagacttaaccctcaaattcataaacaaggccgacttttcggcctttatggatagcattggttatgaagatgacgaggtaatgcagaacaatgttctcattgatgtgataggtaacgtgtacaaagaaaccggagaacttactgaagatggcgagccggtatgtgttaaggaagacggatattttgtaaacgtgcgcatcattaatgatgcaaaaaaatcgtcaatattcgataaatacgcggttgttgttgagcatcaacttcgtggctggatgtga

SEQ ID NO: 262 - DNA, 1041 bp, Artificial Sequence
  Synthetic: STF68B AP2
atggctacatcgacagtaattcctgatgacatcaaaacgctaaaatccgacgttagcaaattaaaaaacgatcaaggaagctacgcaacaaaatcatatgtagacagcaaagatgaaaccgttggtgactggtctgcttcatggtatcagcaagtattgccaactagcggagctatatttgggagaaaactccgctcaactcacaggacggcaggtgttgaggatgcgtattgcgaactatacctcaaaaaatggatagacagtccaggtaacgcaatggcgcgccttaacctgaacgataacgggacaaacatttgctgggactttaccaacctttatggcggtacgatgatttttcccggtgacagcggatacctcaaaatgggtaactgccttatgtcatacagcaagcgtggaagtaacgcgcttattaaatttgattacaccgacacattacagatcaaatatgctaatcatgggtcaaccatgacattaaacacacagggaaccgctcacgctggcgtaacaactagactatggggtaattctagccgtccggttgtttatgaagttggcgtagatgaggctctgtatatgttctacgcacagaaaactaccagcaatacctacgaattaacggttaacggcgcgtgcaatgcaagtgcatttaatcaaggctctgaccgggatctgaaagacaatattcaggtgatcgataatgcaaccgaccgcattcgtaaaatgaacggctatacatacacgcttaaagaaaacggtatgccttacgctggtgttattgcacaagaaaccctggaagccatccccgaagccgtaggggctatgatgaaatatccagacggcgggagtggattagatggagaagaaggtgaacggtattacactgtagattattctggtgttactggcttgcttgttcaggtagccagagagtcagacgacaggataacagcactggaagaagaaaacgcagaattaagacaaagattatctgcaattgaggcggcgcttgcgtctaaataa

SEQ ID NO: 263 - DNA, 2475 bp, Artificial Sequence
  Synthetic: STF-118
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaagcgccattaaacagccctgcactgaccggaacgccaacgacgccaactgcgcgacagggaacgaataatactcagatcgcaaacacggctttcgttatggccgcgattgccgcccttgtagactcgtcgcctgacgcactgaatacgctgaacgagctggcagcggcgctgggcaacgacccgaattttgctaccactatgactaatgcgcttgcgggtaagcaaccgaaagatgctaccctggcggcgctggcggggcttgctactgcggcagacaggtttccgtattttacggggaatgatgttgccagtctggcaactctgacaaaagtcgggcgggatattcttgcgaaatcgaccgtttccgccgttatcgaatatctcggtttacaggaaacggtaaaccgagccgggaacgccgtgcaaaaaaatggcgataccttgtccggtggacttacttttgaaaacgactcaatccttgcctggattcgaaatactgactgggcgaagattggatttaaaaatgatgccgatggtgacactgattcatatatgtggtttgaaacaggtgacaacggcaatgaatacttcaaatggagaagtcgccagagcaccacaacaaaagacctgatgaatcttaaatgggatgctctgtatgttcttgttaaagcccttttcagcagtgaagtaaaaatatctacagtcaatgcactgaggatatttaattcatcttttggtgctatttttcgccgttctgaagaaaacctgtatatcatccctacacgagaaaatgagggtgaaaatggagatattgggccattaaggccattcggcatcaacttaagaacaggagttgtgtctgttggtaatggtgccaggattgatggcgggctggcacttggcacgaataacgcgttgggtgggaactctattgttcttggtgataacgacaccggatttaaacaaaatggcgatggtaatctggatgtttatgctaataacgtccatgttatgcgctttgtttccggaagcattcaaagtaataagaccataaatattacggggcgtgttaatccctcggattacggtaactttgattcccgctatgtgagagatatcagacttggcacacgtgttgtccagaccatgcagaaaggggtgatgtatgagaaagcagggcacgtaattaccgggcttggtattgtcggtgaagtcgatggtgatgaccccgcagtattcaggccaatacaaaaatacatcaatggcacatggtataacgtcgcacaggtgtaa

SEQ ID NO: 264 - DNA, 528 bp, Artificial Sequence
  Synthetic: STF118  AP1
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgacgagaataatataattgtcggcatcaccagagatgcttcaacgcttaaccctgaaggtttcagcgttgtcgaggttcctgatattacctccaaccgacgtgctgatgactcaggtaaatggatgtttaaggatggtgccgtgattaagcggatttatacggcagatgaacaggagcaacaggcagaatcacaaaaggcagctttactttccgaagctgaatccgtgattttgccgctggaacgcgctgtcaggctgaatatggcgacggatgaggaacgcagccgactggaagcatgggaacgctacagcgttctggtcagtcgtgtggatcctgcaaatcccgaatggccggaaatgccgcaataa

SEQ ID NO: 265 - DNA, 2640 bp, Artificial Sequence
  Synthetic: STF-90B
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatataccgcacaggacgccaccaccgcgcgaaaaggccttgtccagctaagtagcgtcaccaacagcgattctgaaacgcttgcggcaacgccaaaggcggttaagacagcgtatgaccttgctaacgggaaatacactgcacaggatgccaccacagcgcgaaaaggtcttgtccagctcagtagcgccaccaacagcgattctgaaacgcttgcggcaacaccaaaagcggtgaagtctgcctatgacaatgctgaaaaacgtcttcagaaagatcagaacggtgcggatattccgggaaaggatactttcacgaaaaatatcggtgcctgtcgtgcttatagcggtgctttgagcactgacgccggaaactggacaaccgctcagtttattgactggctagagtctcagggagcctttaatcatccctactggatgtgcaagtgttcctggtcatacggtaataacaaaattattaccgatactgactgtgggactattcatcttgcaggttgcgtgattgaggttatgggcgttaaagctgcaatgaccattcgtgtgaccactccgagtacatcaagcggtggtggtaccaccagtgcgcaattcacgtatatcaatcacggagctgattatgcgccgggctggcgacgcgactacaatacgaaaaataagcaaccggcttttgcattagggaaaacaggaaatacggttgcaaataataaagcggtaggatggaactgggacagtggtgcttattgtgcacaggatggcggagcatcaaaaatggtgctgcatttttacacgggtgagggaagttgtccggcaatgcagtttcttgtggattataaaaacagggggattttttacaggtcggcacgtgatgggtatggatttgaggctgactggtcagagttttataccacatcacgaaagccaacacctgcggatattcttgctctggcattatcaggcggaagcatgtcaggcagcataaaatttatcaatgatgccttcctgatttgggaaagaaacactgactgggcgaaaattggatttaaaaatgattcagatgctgattctgactcatacatgtggtttgaaactggtgataatggcaatgaatattttaaatggcgcatcaggtctggcagcacaacaaaagacctgatgacgcttaagtctgatgcactacgggttaccgggcaggtgataccatcaaatttcagcaattttgactcccgctatgtccgggatatccggcttggtggtgccgccacatacaaacctgcgaacaatggcatgacatggacacatcaggcaccgtccgggtgtgtatataccggcattattgttcaggataccggctcaaactctgccgataacattggtggcgtatattacagaccggtgcagaaatacattaacgggacatggtataacgtggcgcaggtataa

SEQ ID NO: 266 - DNA, 528 bp, Artificial Sequence
  Synthetic: STF90B AP1
atgcagcatttaaaaaatattacggcgggtaatccaaaaacggttgaacaatatcaattgacaaaggactttgatgttgtctggtttttttcagaagatggtaagaactggtacgaagaacaaaagtattttgctgatgacacgataaaaatagcgtacgacaaagataatatcatccgctatgtggaaaaggatgtgacagctatcagaccggatggattaagtgttgttgaagtggcggatattactgctaaccgacgggcggatatttcagggaactggatgtttaaggatggcacagtgatcaaacgaatttatacggcagaggaattgcaacagcaggcagaaaacaggaaagccagacttcttgcagatgctgaatccgtgattttgccgctggagcgcgctgtcaggctgaatatggcaacagaggaggagcgtagcagactggaaagatgggaacgctacagcgttctggtcagtcgtgtggatcctgcaaatcccgaatggccggaaatgccgcaataa

SEQ ID NO: 267 - DNA, 2616 bp, Artificial Sequence
  Synthetic: STF-117
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatatactgcgcaggatgccaccacagcgcgaaaagggcttgtccagctcagtagcgccaccaacagtgattctgaaaccctcgcggcaacgccaaaagcagtgaagtctgcctatgacaatgctgaaaaacgtcttcagaaagatcagaacggtgcggatattccgggaaaggataccttcacgaaaaatatcggtgcctgtcgtgcttatagcggcgctttgagcactgaagccggaaactggacaaccgctcagtttattgaatggctggattcccgtggtgcatttaatcatccgtactggatgtgcaaaggctcctggtcatatgcaaataacaaaatcattacggataccggatgtggtgatatccacctggctggttgtgtcgtcgaggtcatgggaactaaatctgcaatcactatccgagtgaccacgccgacaacatcaagcggtggcggtacaaccagcgcgcaattcacttacattaatcatggggacggctactcccccggctggcgtcgtgactggaatcgtcagggcgacgcaatgaccggaacgattaatcaggatggcggaagccagaatgcctatatgtctacggccttatgttcaggcaccagaggcggcaaaaaatatctcagaaagtttcgtggtggagaaggagacactatctggcatgaaacagtacagggcggggtagttcgctgggcgactggtaatactgatgctcaggaagaattatcactcagctccgcttatggtctccgttcaagaggtgagattacatcaagcagtgctaatggtctgcgcattgcttatggcaattatggattctttatcaggaatgatggcagcagcacttattttatgttgactaaatcaggtgacagattaggcacttataataatttaagaccactgattataaatgatgccacgggtgctgtatcaatggggcatggcctgagtgttactggtgatattgcctcaagtaccaaagtacgtgccggtagcgggaaaaaattcacggtcagcagcagtaatacatccacgaaggaagccgcattcaatttgtggggaaactcaagtcgtccggtggtggctgaattaggtgatgatgcaggctggcatttttacagtcagagaaatacagataacagcatcacttttgctgttaacgggcaggtatcaccatctaactatagtaattttgattcacgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggcgtatattacagaccggtgcagaaatacattaacgggacatggtataacgtggcacaggtataa

SEQ ID NO: 268 - DNA, 528 bp, Artificial Sequence
  Synthetic: STF117  AP1
atgcagcatttgataaatataaccgcgggtaatccaaaaacggttgaacaatatcaattgacaaaggactttgatgttgtctggttttttacagaagatggtaagaactggtacgaagaacaaaagtattttgctgatgacacgataaaaatagcgtacgacaaggataatattatccgctatgtggaaaaagatgtgacagctatcagaccagatggattaagtgtggttgaagtggcggatattactgctaaccgacgggcggacatttcagggaactggatgtttaaggacggcaaagtgattaaacgcatttatacggcagaggaattgcagcagcaggcagaaaaccggaaagccagacttcttgcagatgctgaatccgtgattttgccactggagcgcgctgtcaggctgaacatggcaacagatgaggagcgtagccgactggaagcatgggaacgctacagtgttctggtcagccgtgtggatcctgcaaatcctgaatggccggaaatgccgcaataa

SEQ ID NO: 269 - DNA, 2397 bp, Artificial Sequence
  Synthetic: STF-66D
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcagcagccaacagtcaaaaagctgcaaaaaccagtgaaaccaactcaaaggcgagcgaaacagcggctgcgaactcagcgaaagcatcggcagcaagccagacggctgcaaaagcaagtgaggatgcagccagagagtatgcaagccaggctgcggagccgtataaacaagttttgcagccgcttcccgatgtgtggataccgtttaacgattcactggatatgattacgggcttttcgccgtcatataaaaagattgttattggtgatgatgaaataacgatgcctggcgataaggttgtaaagtttaaacgcgcatcgaaagcaacctatattaataaatctggtgtgctgacagaggctgccattgacgagccacgatttgaacgtgatggcctgcttattgaggggcaaagaacaaactacatgctcaattcggaaaaccctgccagttgggggcgatcgtcaaatatggatgttcccgaaaccgggacggatagttttggttttacctatggaaagtttgtctgcaacgattctctgattgggcaaacctcagccattaatatggcatcaattgctgcaacaaagtcagttgatgtctcaggcgataataaatacgtgacaacctcatgtcgttttaaaacagaactgcaggtaaggttgcgtatccgatttgataaatatgacggtagcgcaacaacttttcttggtgatgcgtatattgatacacaaacgcttgaaattaatatgacaggtggtgcttccggtagaattacggcacgagtcaggaaggatgaaactacaggatggatttttgctgaggcaacaattcaggcaattgatggtgagttaaaaataggctctcagatacagtattcacctaagcagggaggggcaaccgtatcaggtgactatatttatctggctaccccacaagtagagaatggggcttgtgtatcatcttttattatatcaggaacgacggcggcgactcgtgcgagtgatatggttacgatcccgaccgaaaacaacatttataacagaccgcttacttgtttggtcgaggttaacaggaattggggcgatattcctcctaatgtagcaccgcgtatttttgatttttctggtgtgccgcctattgagtcaatcacatacgcttttaacacaaccgagaaatattacggtcagctttatatgcaaacttataaagcgtcgacaagtagttacgtttctagtttgtttactggtcgaacggatgttcgaaaactcattggtggttttaatatttattctgatggtactaaacgagtagtttctaacggtgaggctactaaaaccatgaaaacggaatggacgggcgtaaaaacgcggacctttattcgaataggaggtcaagccacatcagggacacgtcatctattcggccatttgagaaatcttcgtctctggcataaagaattaactgatgcgcaaatgggggagagtattaaatga

SEQ ID NO: 270 - DNA, 282 bp, Artificial Sequence
  Synthetic: STF66 AP1
atgaaagatttaacactcaaatttgccgacagggccgacttttcggcctttatggagagtattggctattatgatgacgagtcgatgcaggatgatattcttattgacgtgataggtaacgtgtacaaagaaaccggagaactgactgaagatggcgaaccggtatgtgttaaggaagacggatattttgtaaacgtgcgcatcattaatgattcgcaaatatcgtcattattcgatgaatacgtggttgctgttgagcatcaacttcgtggctggatgtga

SEQ ID NO: 271 - protein, 261 aa, Artificial Sequence; identical to SEQ ID NO: 152
  Synthetic: WW55 3.0 AP1

SEQ ID NO: 272 - DNA, 786 bp, Artificial Sequence
  Synthetic: WW55 3.0 AP1
atggcaatatcttctggatgggtaggatcatctgctgtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacaaggatctactccggtagtaattactatcacgggtaatattgtttcccaatctactggcgttccttgtcttgatttccctagctcactgacaaacgaatatgtaacactcattattaactctggtgttcatgtattaggtcgtggaggaaatggcggaagtaactctgctggtggagcaggaggaaatgcaataaataacggaattggaactcgtttaagaataaacaataatggtattattggtggtggcggtggtggcggtgctggtgctagatacaatcctttccctcaaatggatatgaaatttggcggcggtggaggccgtccatttggtgctgcgggtgcggcaggaggcggcgcagcggcagcatctgctggtacaatttctgccccaggtaaaggcactgtttctggggttcattatggaggagatggtggagatttgggagctgctggcaaatcttcatatattaaaggtggtactggtggaactgttcactcgggtggtgctgcgggtaaagctgttactggtaatgcccctcgctgggataaagtaggcacgatctacggtgctcgcgtgtaa

SEQ ID NO: 273 - protein, 86 aa, Artificial Sequence; identical to SEQ ID NO: 153
  Synthetic: WW55 3.0 AP2

SEQ ID NO: 274 - DNA, 261 bp, Artificial Sequence; identical to SEQ ID NO: 177
  Synthetic: WW55 3.0 AP2

SEQ ID NO: 275 - protein, 194 aa, Artificial Sequence
  Synthetic: WT Lambda STF AP1
MAFRMSEQPRTIKIYNLLAGTNEFIGEGDAYIPPHTGLPANSTDIAPPDIPAGFVAVFNSDEASWHLVEDHRGKTVYDVASGDALFISELGPLPENFTWLSPGGEYQKWNGTAWVKDTEAEKLFRIREAEETKKSLMQVASEHIAPLQDAADLEIATKEETSLLEAWKKYRVLLNRVDTSTAPDIEWPAVPVME

SEQ ID NO: 276 - DNA, 585 bp, Artificial Sequence
  Synthetic: WT Lambda STF AP1
atggcattcagaatgagtgaacaaccacggaccataaaaatttataatctgctggccggaactaatgaatttattggtgaaggtgacgcatatattccgcctcataccggtctgcctgcaaacagtaccgatattgcaccgccagatattccggctggctttgtggctgttttcaacagtgatgaggcatcgtggcatctcgttgaagaccatcggggtaaaaccgtctatgacgtggcttccggcgacgcgttatttatttctgaactcggtccgttaccggaaaattttacctggttatcgccgggaggggaatatcagaagtggaacggcacagcctgggtgaaggatacggaagcagaaaaactgttccggatccgggaggcggaagaaacaaaaaaaagcctgatgcaggtagccagtgagcatattgcgccgcttcaggatgctgcagatctggaaattgcaacgaaggaagaaacctcgttgctggaagcctggaagaagtatcgggtgttgctgaaccgtgttgatacatcaactgcacctgatattgagtggcctgctgtccctgttatggagtaa

SEQ ID NO: 277 - DNA, 7300 bp, Artificial Sequence
  Synthetic: Payload p7.3
cctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtccctcctgttcagctactgacggtactgcggaactgactaaagtagtgcgtaacggcaaaagcaccgccggacatctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcactttatagctagctcagcccttggtacaatgctagcgttttcattaaagaggagaaaggaagccatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacaaaagaacggtatcaaagctaacttcaaaattcgccataacgttgaagacggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagtcagtttcacctgttttacgttaaaacccgcttcggcgggtttttacttttgggtttagccgaacgccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaagaacctgtaaagtgataatgattatcatctacatatcacaacgtgcgtaaagggactataacaagacgcaaacggaggtaggctcactcctacttcggaaacttaaccgaagaactaggacggtattgtttgcgcttggaattggccttgaagtaagtcaggttttgacggaacgattagttacagggggggaacagtcgttggtcgccaccaagtcgatttttggcttacctcttatctcgtagttggtgagggttgggattcacgggacgagatccagcctaagtatattgtcacttctgattcgttcgatcacttactccccttacttatcctgcggctactgtttccgctggctcgtaagctctacgttcggcaatctacccgcgaggtcagacgtgacactcttaaactaaaaattggtagcttctttggctgaattgctggatcttattcgttcacccaataaaacggtacagcttcaagcaatatcctcagtaagttaatacccgttgtactattactttcacgaccgttcgacgttcccgctctatttattaagagctgtcacttcgagtctttagctcacttaggaattagctgagtttaggctcagccctcttgggttgcttgtactttcagagttattcgcacggctggttttgtcgagtggggaattgtggttgaccgaaagtccgctatccttcaacgccgaatcagctcttgccctttactatcttcaatctcttggaggctattacgggcgggggcaagagattagaactgcaagacacccgttgataatcgagtcgctcgatagattgtcgagagccggagagattagtacgttattcaaggcaatacgtgcagggttaatctgggcgcgttgtagtctacgctggcgtaagtccccaataacacgctcgtccggcgagtcacgatcctctaggcggtgttcaacgcgtacgccagctatttgggatacttagctacgttacacgtaagaatatcttagcggaggatcgccctgcttccgcttggacggataaacgggagagtgggcgcgtatagcgcaggcggtgtgaaggcttttaagtaattctagccctctttgaacggtatttcccaatttggagattaccggatagcgcgtttaaatgagtgtcagagaaacggaagccgaagtctttccattccggatgtttggaaatgctctgtttatagaagtcgatgaacttacggcagtcctctatattaaattcgaatttttcataccctttctgcgggctaccgtttttagtgtgcgtgctatgattgcggatgcgcagaatatcctcagacgggttgtagaatttgatgcttttcgcggaaaagaacactttcggtaacattttattcgcacccggcaggagcttgtacacgattttcttatagccttcacccttgttttctttgatcgctttatcgtcgaagatcttgttgttcttcttgttcattacgcccagatagtatttgtcgtctttgatgaacaggattgcggtgttgtccggctctttgttcttatcccagccgttcgccagcgtgctgttttcgaagttcagtttgaatttctcgtcagagtaaggcttctgcgtgatgtagttgcggattttattgtagagagggacgatgtttgccagttcgaagtaacattcttcgaacaccagatagaagtgttcatctttatccagaatgttcgccttgtcctcgctctggctgatgtggaagattttgagcttgtgtaataagttattcgtctgatctaataagtctttaattgctttcacatcgtcctccgcagatgcttgaagcagatctttcttaccctgattctggtacttgatagagatctgcgccagattgtctttgttttgagcaatttcgtcgaagatcatcgggattgccgcaaagttcgccagaatttcctcaaaacgacactgtttatcaatatcacgatgtttattaaattcctcaagtgccagtttgatagtttctaagctcaggtatttagctttttctgttttctttgcaatcagttcctgttccttcttggacgggttgtccagatttttcggcgcgatttgttgggtgatgtattccaaaactgccgtgccgatcacgctatagtcatcgaaaacttgttgactgagatcggtcagagatttgtcgtttttaaagtaaatcttagacagatctagtttctgcgctttgaggtcgtcaaagagcagggacagagtttctttaatagatttctcttccacggttttgaacgccgcaatctgctcataaaagctctgcatcgtggtgacaacgtcgctatcatcttccagtttatcaattacgaaggatttagattcggtgtccgataaaatctgtttaaacagaacggacattttatactttttcagggttttgtcgttgatttgttggctatacaggttaatgtattcgttgatgcccttacgcttggtgttttcgccgttaacaaatttgccaccaataatggtgttgaatttggtgatgccagattgattcaggtaattgttgaaattagcgatttcgaaaacctcgtccagtgagaaaacacgctggttaacttcggaggttttatagtcgatgtcgaaggtcagttcttccgccagatctttcttgatctgttcatagttaatagcttccggtgctttgtctttcagagattcatatttcgctttgttttccagaaacttcggcaggttgtcgtccacgatacgataaataatagaggtcggaatatcgttgctcgaatatacattcttacggttttcatgaaaacctttgaaatacgtcgtccagcctttgaaagacttgatgatttcggtattcgaatatgacctgatcaaagataaacgtttcaccgaagataagttctttttccactgtccgattaccatcaacttcaaatctagcggtgcgaacaagttcaacgatgaaattaacttattactgaaagagaaagctaatgacgtacacatcttatctattgatcgcggtgaacgtcatttagcatactatacactggtagatggtaaaggtaatattattaaacaggatactttcaatattatcggtaatgaccgtatgaaaaccaactatcacgataagctggcggcgatcgaaaaagatcgtgattctgcgcgtaaagattggaagaaaattaacaatatcaaagaaatgaaagaaggctatctgagccaagtggtgcacgagatcgcaaaactggtgattgaatataacgctatcgtggttttcgaagatctgaactttggttttaaacgtggtcgcttcaaagtagaaaaacaggtgtaccaaaaactggaaaaaatgctgattgaaaaactgaactatctggtttttaaagacaacgaatttgacaaaacgggtggcgtactccgtgcctatcagctgaccgctccgttcgaaacgttcaagaaaatgggtaaacaaacggggattatctattatgtgccagctggtttcacctccaagatttgtccagttacgggcttcgttaaccagctgtacccgaaatacgagagcgttagcaaatctcaagaatttttcagcaaattcgacaagatctgctataatctggataaaggctatttcgagttcagcttcgattacaaaaacttcggcgataaagcggctaaaggtaagtggactattgctagctttggtagccgtctgattaactttcgcaactccgacaaaaaccataattgggacacgcgtgaagtgtatccgaccaaagaactggaaaaattactgaaagactattccggacactcagaagggttataggaatagtcactactggggtaagcacttcggaaattatattattctcgcttcttattgcggtaacgtgatcctgaacgatacttattactttgtaatttacttaacgtcggagtccctgcaatcttctagtacccgcttcccgaatacaggagataactttttaacactcaagagttgcttcgtgcttagccagtcttggatttgattgctctaatccttcaacgtgtcaaagacagtgtatctggtcaagtaaagtctagagaaaggcgtagtcagttacggagttatcccaccttagtgttactccgatttaatttctgctttctttgatttctacccgactttcgccgtgacttcaatagagaggcaggctcttgctatttctttcaagggcttgtccaactacctaattaagataaagatacggcagttgacgcactgccgataatttctttacgtcagcgaaattaaatcgagcaccagtcgtagagtcgcggttgcctagcagtttatctcgcgtacgggccttcgctacttacacgatacctagtacgtggattcgggtagcaccagaagtctatagcatgtgcatacctttggtcgaaaaaaaaagcccgcactgtcaggtgcgggcttttttcagtgtttccttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccagggattggcactgacgaaaaacatattttcgataaac

SEQ ID NO: 278 - protein, 1131 aa, Artificial Sequence
  Synthetic: gpJ variant 1A2
MGKGSSKGHTPREAKDNLKSTQLLSVIDAISEGPIEGPVDGLKSVLLNSTPVLDTEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVMGNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQYCDQSVPDGFGGTEPRITCNAYLTTQRKAWDVLSDFCSAMRCMPVWNGQTLTFVQDRPSDKTWTYNRSNVVMPDDGAPFRYSFSALKDRHNAVEVNWIDPNNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTALISLVDGSGNPVSVEVQSVTDGVKVKVSRVPDGVAEYSVWELKLPTLRQRLFRCVSIRENDDGTYAITAVQHVPEKEAIVDNGAHFDGEQSGTVNGVTPPAVQHLTAEVTADSGEYQVLARWDTPKVVKGVSFLLRLTVTADDGSERLVSTARTTETTYRFTQLALGNYRLTVRAVNAWGQQGDPASVSFRIAAPAAPSRIELTPGYFQITATPHLAVYDPTVQFEFWFSEKQIADIRQVETSTRYLGTALYWIAASINIKPGHDYYFYIRSVNTVGKSAFVEAVGRASDDAEGYLDFFKGKITESHLGKELLEKVELTEDNASRLEEFSKEWKDASDKWNAMWAVKIEQTKDGKHYVAGIGLSMEDTEEGKLSQFLVAANRIAFIDPANGNETPMFVAQGNQIFMNDVFLKRLTAPTITSGGNPPAFSLTPDGKLTAKNADISGNVNANSGTLNNVTINENCRVLGKLSANQIEGDLVKTVGKAFPRDSRAPERWPSGTITVRVYDDQPFDRQIVIPAVAFSGAKHEKEHTDIYSSCRLIVRKNGAEIYNRTALDNTLIYSGVIDMPAGHGHMTLEFSVSAWLVNNWYPTASISDLLVVVMKKATAGITIS

SEQ ID NO: 279 - DNA, 3396 bp, Artificial Sequence
  Synthetic: gpJ variant 1A2
atgggtaaaggaagcagtaaggggcataccccgcgcgaagcgaaggacaacctgaagtccacgcagttgctgagtgtgatcgatgccatcagcgaagggccgattgaaggtccggtggatggcttaaaaagcgtgctgctgaacagtacgccggtgctggacactgaggggaataccaacatatccggtgtcacggtggtgttccgggctggtgagcaggagcagactccgccggagggatttgaatcctccggctccgagacggtgctgggtacggaagtgaaatatgacacgccgatcacccgcaccattacgtctgcaaacatcgaccgtctgcgctttaccttcggtgtacaggcactggtggaaaccacctcaaagggtgacaggaatccgtcggaagtccgcctgctggttcagatacaacgtaacggtggctgggtgacggaaaaagacatcaccattaagggcaaaaccacctcgcagtatctggcctcggtggtgatgggtaacctgccgccgcgcccgtttaatatccggatgcgcaggatgacgccggacagcaccacagaccagctgcagaacaaaacgctctggtcgtcatacactgaaatcatcgatgtgaaacagtgctacccgaacacggcactggtcggcgtgcaggtggactcggagcagttcggcagccagcaggtgagccgtaattatcatctgcgcgggcgtattctgcaggtgccgtcgaactataacccgcagacgcggcaatacagcggtatctgggacggaacgtttaaaccggcatacagcaacaacatggcctggtgtctgtgggatatgctgacccatccgcgctacggcatggggaaacgtcttggtgcggcggatgtggataaatgggcgctgtatgtcatcggccagtactgcgaccagtcagtgccggacggctttggcggcacggagccgcgcatcacctgtaatgcgtacctgaccacacagcgtaaggcgtgggatgtgctcagcgatttctgctcggcgatgcgctgtatgccggtatggaacgggcagacgctgacgttcgtgcaggaccgaccgtcggataagacgtggacctataaccgcagtaatgtggtgatgccggatgatggcgcgccgttccgctacagcttcagcgccctgaaggaccgccataatgccgttgaggtgaactggattgacccgaacaacggctgggagacggcgacagagcttgttgaagatacgcaggccattgcccgttacggtcgtaatgttacgaagatggatgcctttggctgtaccagccgggggcaggcacaccgcgccgggctgtggctgattaaaacagaactgctggaaacgcagaccgtggatttcagcgtcggcgcagaagggcttcgccatgtaccgggcgatgttattgaaatctgcgatgatgactatgccggtatcagcaccggtggtcgtgtgctggcggtgaacagccagacccggacgctgacgctcgaccgtgaaatcacgctgccatcctccggtaccgcgctgataagcctggttgacggaagtggcaatccggtcagcgtggaggttcagtccgtcaccgacggcgtgaaggtaaaagtgagccgtgttcctgacggtgttgctgaatacagcgtatgggagctgaagctgccgacgctgcgccagcgactgttccgctgcgtgagtatccgtgagaacgacgacggcacgtatgccatcaccgccgtgcagcatgtgccggaaaaagaggccatcgtggataacggggcgcactttgacggcgaacagagtggcacggtgaatggtgtcacgccgccagcggtgcagcacctgaccgcagaagtcactgcagacagcggggaatatcaggtgctggcgcgatgggacacaccgaaggtggtgaagggcgtgagtttcctgctccgtctgaccgtaacagcggacgacggcagtgagcggctggtcagcacggcccggacgacggaaaccacataccgcttcacgcaactggcgctggggaactacaggctgacagtccgggcggtaaatgcgtgggggcagcagggcgatccggcgtcggtatcgttccggattgccgcaccggcagcaccgtcgaggattgagctgacgccgggctattttcagataaccgccacgccgcatcttgccgtttatgacccgacggtacagtttgagttctggttctcggaaaagcagattgcggatatcagacaggttgaaaccagcacgcgttatcttggtacggcgctgtactggatagccgccagtatcaatatcaaaccgggccatgattattacttttatatccgcagtgtgaacaccgttggcaaatcggcattcgtggaggccgtcggtcgggcgagcgatgatgcggaaggttacctggattttttcaaaggcaagataaccgaatcccatctcggcaaggagctgctggaaaaagtcgagctgacggaggataacgccagcagactggaggagttttcgaaagagtggaaggatgccagtgataagtggaatgccatgtgggctgtcaaaattgagcagaccaaagacggcaaacattatgtcgcgggtattggcctcagcatggaggacacggaggaaggcaaactgagccagtttctggttgccgccaatcgtatcgcatttattgacccggcaaacgggaatgaaacgccgatgtttgtggcgcagggcaaccagatattcatgaacgacgtgttcctgaagcgcctgacggcccccaccattaccagcggcggcaatcctccggccttttccctgacaccggacggaaagctgaccgctaaaaatgcggatatcagcggtaacgtgaatgcgaactccgggacgctcaacaacgtcacgattaacgagaactgtcgggttctgggaaaattgtccgcgaaccagattgaaggcgatctcgttaaaacagtgggcaaagctttcccccgggactcccgtgcaccggagcggtggccatcaggaaccattaccgtcagggtttatgacgatcagccgtttgaccggcagattgttattccggcggtggcattcagcggcgctaaacatgagaaagagcatactgatatttactcctcatgccgtctgatagtgcggaaaaacggtgctgaaatttataaccgtaccgcgctggataatacgctgatttacagtggcgttattgatatgcctgccggtcacggtcacatgacactggagttttcggtgtcagcatggctggtaaataactggtatcccacagcaagtatcagcgatttgctggttgtggtgatgaagaaagccactgcaggcatcacgattagctga

SEQ ID NO: 280 - protein, 252 aa, Artificial Sequence
  Synthetic: WW11 ID1 branched
YIPWIYNSGSANGGETTIRIPDETAGAPFMIVNGDWQTEGYDFEYDPVTFEVSFTTPLEPGDFVVVMRTGVPATPDNPNVSDWVTINWLYNQGAAVGGEQVIDIPYTFQSVPAVYKNGLRFYKGLTNNSYTVDSDNNRIILTEPLATNDRLIVQLGGEAKVLKVVDHTIQEVARSANVKDSQVILSVDTVQSLNGKAVVYDVVAQRIYGLPTLPSNVYINTVANGKLYYNPGNVEVTLLDVPGSGTEVKSAL

SEQ ID NO: 281 - protein, 181 aa, Artificial Sequence
  Synthetic: WW11 ID2 branched
MNEMFSQGGKGSTGILTNKQAVARHFGVKQSEVVYFSVGAVLSGYKVVYDKESQRAYSLPADIGSGVTAVSLSPAGVLVHSAGNVDLGALAVTREEYVTLPGSFDTGVTVNTKNELVVFTDGKYRWEGALPKVVAAGSTPESTGGVGVGLWKSVGNASLRDELSNNDGFNLIGAAYYNDVR

SEQ ID NO: 282 - protein, 1446 aa, Artificial Sequence
  Synthetic: WW11 K1F chimeric stfa
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSYIPWIYNSGSANGGETTIRIPDETAGAPFMIVNGDWQTEGYDFEYDPVTFEVSFTTPLEPGDFVVVMRTGVPATPDNPNVSDWVTINWLYNQGAAVGGEQVIDIPYTFQSVPAVYKNGLRFYKGLTNNSYTVDSDNNRIILTEPLATNDRLIVQLGGEAKVLKVVDHTIQEVARSANVKDSQVILSVDTVQSLNGKAVVYDVVAQRIYGLPTLPSNVYINTVANGKLYYNPGNVEVTLLDVPGSGTEVKSALAKQDGLSLIGQCNSIADLRNVEPVMDGQRILVKQHTAGTGKGGGTFQAKLSGVGLTDDNGVTVKTVGGAAWVRVGADRVNPYMYGALGSGNDDTLAVQACLNSGKATNITDVHHVSNVTMNKSSASIYGSGLHYTRLHQLPAAVGSLLTIADTCSLTVIDSLGLYGTGYKQGTAFTTGTRGIDVLTPTGLSNNYPDHTTSDPRRDLVITKVHIAGFDEYGLNVDSGNFSVTTESVLINHIKQVGARCATTDWTWTNIQINTCGKQCLILDGCGNGRIIGGKFIWANWLPYGASGQFPGITINNSQNMVINGIEVQDCGGNGIEFTDSYSISMNGLNTNRNGINSTAEFYNLVFNRSDVEINGFVGLNYKVNSGSPDNSSSGNLKFLSSDCNVTLNGKLETGYMGIEFIGDTRVIQPTSSYIKLNGLVNYAGSGIQTINEVPTFDGVSTTPVYVPISSVVGQTNGLRLSQANKDKVIYTRKVGPEGVTMAAVITPTIGGAEIFNLMAIGTGFSSASNSLYFQLEIAADGSQNVSLLLSGDGTTQILPGTLPAALKLQSGEPYHVALGAKAGYFWWSILNLNTGKRIRRSFRGAYLPKPFASIFGLVSSPVFFSGAGIGDSGCSGVGAKIYLGSFSDENDYVSSRYYSLVNPVDPTKMYSFRILDSTI

SEQ ID NO: 283 - protein, 1001 aa, Artificial Sequence
  Synthetic: WW11 K1F chimeric stfb
MNEMFSQGGKGSTGILTNKQAVARHFGVKQSEVVYFSVGAVLSGYKVVYDKESQRAYSLPADIGSGVTAVSLSPAGVLVHSAGNVDLGALAVTREEYVTLPGSFDTGVTVNTKNELVVFTDGKYRWEGALPKVVAAGSTPESTGGVGVGLWKSVGNASLRDELSNNDGFNLIGAAYYNDVRGAKGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 284 - DNA, 7378 bp, Artificial Sequence
  Synthetic: WW11 K1F chimeric stf
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgtatatcccctggatttataactctggttcagccaatgggggagagactaccattcgtattccagatgaaactgccggtgcaccattcatgattgttaatggtgattggcagactgaaggatatgactttgagtatgacccagtgacttttgaggttagtttcactaccccactggaacctggcgactttgttgtagtaatgcgtactggtgttcctgcaaccccggataatcctaatgtttctgattgggtaaccattaactggttatataaccaaggtgctgctgtaggtggggaacaggtaattgatattccctataccttccaatctgtgcctgctgtatacaagaatggtttacgcttctacaaagggttaactaataactcttatacggttgactcggataacaaccgaatcattcttactgaacccttggctacgaatgatcgtttaattgttcagttgggtggggaagctaaggtactgaaagtggtagaccatactatccaggaagttgctcgttcagctaacgtaaaggattcacaagtaattcttagtgtggatactgtgcaatctctgaatggaaaagcagttgtgtatgatgtagttgctcaacgtatctatggattacccacattacctagcaacgtttatatcaatactgttgccaacggcaagctctactataatccaggtaacgtggaagtaaccttacttgacgttcctggttccggtactgaagtaaaatctgctttagctaagcaggatggcctgagtctaattggtcagtgtaatagtattgctgatttaagaaacgtagaaccagttatggatggtcaacgcattcttgttaaacagcatactgctggaacaggtaaaggtggtggcacattccaggcaaagctttctggggtaggtttaacagatgataatggtgtaaccgttaagacggttgggggtgcagcatgggttcgtgttggagcagaccgagttaacccatacatgtatggtgcacttggttccggtaatgatgataccttagcagtacaggcatgtcttaatagtggtaaagctaccaatattacagatgttcaccatgtttctaacgttacaatgaataagagcagtgcctctatttatggttctggattgcactataccagactacatcaactacctgctgctgtaggttctttgcttactattgcagatacctgctcattgactgttattgatagtcttgggctgtatggcacgggttataagcagggtactgcttttaccacaggtactcgcggcattgatgtactaaccccaactggtttatccaataactacccagaccatactacttcagacccacgcagagatttggttattactaaggttcatattgcaggttttgatgagtatggccttaatgtggactctggtaactttagcgttactacagagtctgtattgattaaccacattaaacaggttggtgcacgttgtgccactactgactggacttggacaaacatccagattaatacctgcggtaaacaatgtcttattttggatggctgtggcaatggtcgtatcatcggaggtaagtttatctgggccaactggttaccatatggtgcatccggtcagtttccgggtattaccatcaataacagtcaaaacatggttatcaacggtattgaggtgcaggactgtggtggtaatggtattgagtttactgatagctactcaatcagcatgaatggattgaatactaaccgtaacggtattaactctacggcagaattctataacctggtgttcaatcgttctgatgtagaaatcaatggttttgttggtcttaactataaagttaatagtggctcaccagacaattctagctcaggcaaccttaagttcttgtcgagtgattgtaatgtaactcttaatggaaaacttgagacaggctatatgggtatagagttcattggcgatactcgtgtaattcagccaacgtcttcttacattaaacttaacggtctggttaactatgctggttctggtattcagactattaatgaagtacctacttttgatggagttagtactactcctgtatacgtaccaatttcttctgttgttgggcagaccaatggattacgcctgtctcaagctaacaaagacaaggttatttatactcgtaaggttgggccagaaggtgtaacaatggctgctgttattactccaacaattgggggggcagagatatttaacctcatggctattggtacaggttttagctctgcaagtaacagtctgtatttccagttagaaatagctgctgatggttctcagaatgtgtctttacttctgagtggggatggtactacgcagattctgcctggtactttacctgctgcacttaagttacaatccggcgaaccgtatcatgtagctttgggggctaaggctggatacttctggtggagtattttaaatctcaatactggtaagcgtatccgtcgttccttccgaggtgcttacttacctaaaccattcgcttctatctttggtttagtcagttctccagtattcttctctggggcaggtattggtgattcaggatgctctggtgttggtgccaagatttatcttggttccttctctgacgagaatgattatgtatcctctcgttattatagtttggttaacccagttgacccaactaagatgtatagcttccgtatattagacagtactatttaacttgtgcataatagtcaaaggaaagtactatatgaacgaaatgttctcacaaggtggtaagggttcaactggaatcttaaccaacaaacaagcagtagcccgtcactttggggttaaacaatcagaggttgtttacttctctgttggtgcagtactaagtggttataaagttgtctacgacaaagagtcccaacgtgcttactccttacctgctgacattggttcaggggttactgctgtaagtcttagtcctgccggtgtgttggttcactcagcaggtaatgtggacttaggtgcactagctgttactcgtgaggagtatgtaacattacctggttcatttgataccggtgtaacagttaatactaagaatgaactggttgtgtttactgatggcaagtatcgttgggaaggcgctttacctaaagtggttgctgctggttcaaccccagaatcaacagggggtgttggtgtagggctatggaaaagtgttggcaatgcctcattacgggatgaattatctaataatgacggtttcaatctaattggggctgcttattataacgatgtgagaggtgcgaagggcgatggcgttaccgacgacactgcagcgctgacttccgccctgaacgatactccggtgggtcagaaaatcaacggtaacggtaaaacttataaagttacgtccctgccggacatctcccgctttatcaacacccgtttcgtgtatgaacgtatcccaggccagccgctgtactacgcatcggaagagttcgttcagggtgagctttttaaaatcaccgacactccgtattataacgcctggccacaggataaggctttcgtgtacgaaaacgttatctatgctccgtacatgggttccgaccgtcacggtgtcagccgactgcacgtaagctgggtgaaatcgggcgacgatggtcagacctggagcacgcctgagtggctgaccgaccttcatccggactatccgaccgttaactatcactgcatgagcatgggcgtctgtcgcaaccgtctgttcgcaatgatcgaaacccgtacgctggcaaaaaacgctctgactaactgcgccctgtgggatcgtccaatgagccgctctctgcacctgacgggtggtattaccaaagcagcgaaccagcgttacgccaccattcacgtaccggatcatggtctgttcgttggtgactttgtaaatttctctaattctgcagttaccggtgtgtctggcgacatgaccgttgcgaccgtaatcgataaggacaatttcaccgtcctgaccccgaaccagcaaacctctgatcttaacaacgctggcaagaactggcacatgggcactagctttcacaaatctccgtggcgtaaaaccgatctgggcctgatcccgtctgtaactgaagtgcactccttcgcgaccattgataacaacggtttcgctatgggttatcaccaaggtgatgttgcaccgcgtgaagtcggcctcttttattttccggacgcattcaacagcccgtccaactacgtgcgccgtcagattccgtctgaatatgaaccggacgcctccgagccgtgcattaagtactatgacggtgtgctgtacctgattacccgtggcacccgtggtgatcgtctgggttcatctctgcatcgctcccgcgacattggtcagacgtgggaaagtctgcgcttcccgcacaatgttcatcacaccaccctgccgttcgcgaaagtcggcgatgacctgatcatgtttggctccgaacgtgctgaaaacgaatgggaagcgggcgccccagacgatcgctacaaggcatcttacccgcgcaccttctacgcgcgtctgaacgtgaacaactggaacgcagacgatatcgaatgggtaaacatcaccgaccagatctaccagggtggtatcgtgaactctggtgtgggcgttggttccgttgtagttaaagataactacatctattatatgttcggcggcgaagaccacttcaacccgtggacttacggcgataactccgcgaaagacccgttcaaatccgatggtcacccttctgacctctattgttacaaaatgaaaatcggtccggacaaccgtgtttcccgcgattttcgctacggcgctgttccaaaccgtgcagttccggtattcttcgacacgaacggcgtgcgtaccgttccggctccgatggaattcaccggcgacctgggtctgggccacgtaaccattcgtgcctccaccagctctaacatccgttccgaagtactcatggaaggtgaatacggctttatcggtaagtctatcccgacggacaacccggcaggtcagcgtatcatcttctgcggcggtgagggtacctctagcaccaccggcgcgcaaatcaccctgtacggcgctaacaacaccgactctcgtcgtatcgtatacaacggtgatgaacatctgttccagtccgcagacgtgaaaccgtacaacgacaacgtcaccgcactgggtggtccatccaaccgtttcaccactgcgtacctgggttccaacccgatcgttactagcaatggtgaacgcaaaactgaaccggtagtgtttgacgacgcttttctggacgcatggggcgatgttcattacatcatgtatcagtggctggatgccgtgcagctgaaaggtaacgacgcgcgtatccactttggtgtgatcgcacagcagattcgcgatgtcttcatcgcacacggtctgatggatgaaaatagtactaactgtcgctatgcggtgctgtgctatgacaaatacccgcgtatgaccgacaccgtgttctcgcacaatgagattgttgaacataccgatgaagaaggtaacgtgactactaccgaagaaccggtttataccgaagtggttattcacgaagaaggtgaagaatggggcgtgcgtcctgatggtatctttttcgcggaggcagcgtaccagcgtcgcaaactggaacgcatcgaagctcgtctgtcggcactggaacagaaataa

What is claimed is:

1. An engineered branched receptor binding multi-subunit protein complex (branched-RBP) comprising two or more associated bacteriophage derived receptor binding proteins (RBP):
    wherein the two or more associated bacteriophage derived RBPs comprise an interaction domain (ID) that mediates the association of the RBP's with one another to form the branched-RBP, and
    wherein at least one of the two or more associated bacteriophage derived RBPs is a chimeric RBP comprising a fusion between the N-terminal domain of a RBP from a lambda or lambda-like bacteriophage and the C-terminal domain of a different RBP and wherein the ID is inserted between the N-terminal domain and the C-terminal domain of the chimeric RBP.

2. The engineered branched-RBP of claim 1, wherein the association is a non-covalent association.

3. The engineered branched-RBP of claim 1, wherein at least one of the two or more receptor binding protein (RBP) comprises a chimeric RBP, wherein said chimeric RBP is selected from the group consisting of:
    (i) a fusion between the N-terminal domain of a RBP from a lambda or lambda-like bacteriophage and the C-terminal domain of a different RBP, wherein said different RBP is derived from any bacteriophage or bacteriocin,
    wherein said N-terminal domain is fused to said C-terminal domain within one of the amino acid regions selected from positions 1-150, 320-460 or 495-560 of the N-terminal RBP with reference to the lambda stf sequence (SEQ ID NO:1) and wherein said chimeric RBP contains an interaction domain inserted between the N-terminal and C-terminal domain: and
    (ii) a fusion between the N-terminal domain of a RBP from a lambda or lambda-like bacteriophage and the C-terminal domain of a different RBP, wherein said different RBP is derived from any bacteriophage or bacteriocin,
    wherein said RBP from a lambda or lambda-like bacteriophage and the other RBP have homology in one or more of three amino acids regions ranging from positions 1-150, 320-460 and 495-560 of the N-terminal RBP with reference to the lambda stf sequence (SEQ ID NO:1) and
    wherein said N-terminal domain is fused to said C-terminal domain within one of the amino acid regions selected from positions 1-150, 320-460 or 495-560 of the N-terminal RBP with reference to the lambda stf sequence (SEQ ID NO:1) and
    wherein said chimeric RBP contains an interaction domain inserted between the N-terminal and C-terminal domain.

4. The engineered branched-RBP of claim 3, wherein the chimeric RBP is selected from the group consisting of;
    (i) a chimeric RBP, wherein the N-terminal domain of the chimeric RBP is fused to said C-terminal domain within one of the amino acids regions selected from positions 80-150, 320-460, or 495-560 of the N-terminal RBP with reference to the lambda bacteriophage stf sequence (SEQ ID NO:1) and wherein said chimeric RBP contains an interaction domain, inserted between the N-terminal and C-terminal domain; and
    (ii) a chimeric RBP, wherein the N-terminal domain and the C-terminal domain are fused within said region at an insertion site having at least 80% identity with an insertion site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203) wherein said chimeric RBP contains an interaction domain inserted between the N-terminal and C-terminal domain.

5. The engineered branched-RBP of claim 3, wherein the C-terminal domain of the different RBP has a depolymerase activity against an encapsulated bacterial strain.

6. The engineered branched-RBP of claim 1, wherein one or more of the IDs is selected from the group consisting of SEQ ID NOS.: 131-134 and 280-281.

7. The engineered branched-RBP complex of claim 1, wherein the at least one or more receptor binding protein (RBP) comprises a chimeric RBP selected from the group consisting of:
    (i) a chimeric RBP comprising a fusion between the N-terminal domain of a RBP from a lambda bacteriophage and the C-terminal domain of a different RBP, wherein said different RBP is derived from any bacteriophage or bacteriocin; and
    wherein said N-terminal domain is fused to said C-terminal domain within one of the amino acids regions selected from positions 1-150, 320-460 or 495-560 of the N-terminal RBP with reference to the lambda stf sequence (SEQ ID NO:1) and wherein said chimeric RBP contains an interaction domain inserted between the N-terminal and C-terminal domain; and
    (ii) a chimeric RBP comprising a fusion between the N-terminal domain of a RBP from a lambda bacteriophage and the C-terminal domain of a different RBP, wherein said different RBP is derived from any bacteriophage or bacteriocin, wherein said RBP from a lambda bacteriophage and the other RBP have homology in one or more of three amino acids regions ranging from positions 1-150, 320-460, and 495-560 of the N-terminal RBP with reference to the lambda stf sequence (SEQ ID NO:1); and wherein said N-terminal domain is fused to said C-terminal domain within one of the amino acid regions selected from positions 1-150, 320-460, or 495-560 of the N-terminal RBP with reference to the lambda stf sequence (SEQ ID NO:1); and wherein said chimeric RBP contains an interaction domain inserted between the N-terminal and C-terminal domain.

8. The engineered branched-RBP of claim 7, wherein said N-terminal domain of the chimeric RBP is fused to said C-terminal domain within one of the amino acids regions selected from positions 80-150, 320-460, or 495-560 of the N-terminal RBP with reference to the lambda stf sequence (SEQ ID NO:1) and wherein said chimeric RBP contains an interaction domain inserted between the N-terminal and C-terminal domain.

9. The engineered branched-RBP of claim 7, wherein the N-terminal domain and the C-terminal domain are fused within said region at an insertion site having at least 80% identity with insertion site selected from the group consisting of amino acids SAGDAS (SEQ ID NO:190), ADAKKS (SEQ ID NO:190), MDETNR (SEQ ID NO:191), SASAAA (SEQ ID NO:192), GAGENS (SEQ ID NO:193), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202), and VDRAV (SEQ ID NO:203) wherein said chimeric RBP contains an interaction domain inserted between the N-terminal and C-terminal domain.

10. The engineered branched-RBP of claim 1, wherein at least one of the two or more associated receptor binding proteins (RBP) comprises a chimeric RBP comprising an amino acid sequence selected from the group consisting SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 135 to 144, 147, 150, 151, 154, 157, 160, 163, 215, 216, 219, 221, 223, 225, 227, 229, 232, 325, 237, 239, 241, 282 and 283.

11. A bacterial delivery vehicle comprising an engineered branched-RBP of claim 1.

12. The bacterial delivery vehicle of claim 11 wherein said bacterial delivery vehicle is a bacteriophage or is a packaged phagemid.

13. The bacterial delivery vehicle of claim 11, wherein the chimeric RBP is selected from the group consisting of:
(i) a chimeric RBP that comprises a fusion between the N-terminal domain of a RBP from a lambda or lambda-like bacteriophage and the C-terminal domain of a different RBP and
wherein said N-terminal domain is fused to said C-terminal domain within one of amino acids regions selected from positions 1-150, 320-460 or 495-560 of the N-terminal RBP with reference to the lambda stf sequence (SEQ ID NO:1)
wherein said chimeric RBP contains an interaction domain inserted between the N-terminal and C-terminal domain; and
(ii) a chimeric RBP that comprises a fusion between the N-terminal domain of a RBP from a lambda or lambda-like bacteriophage and the C-terminal domain of a different RBP, wherein said RBP from a lambda or lambda-like bacteriophage, and the other RBP have homology in one or more of three amino acids regions ranging from positions 1-150, 320-460, and 495-560 of the N-terminal RBP with reference to the lambda stf sequence (SEQ ID NO:1) and wherein said N-terminal domain is fused to said C-terminal domain within one of the amino acid regions selected from 1-150, 320-460 or 495-560 of the N-terminal RBP with reference to the lambda stf sequence (SEQ ID NO:1); and wherein said chimeric RBP contains an interaction domain inserted between the N-terminal and C-terminal domain.

14. The bacterial delivery vehicle of claim 13, wherein said different RBP is derived from any bacteriophage or bacteriocin.

15. The bacterial delivery vehicle of claim 13, wherein said N-terminal domain of the chimeric RBP is fused to said C-terminal domain within one of the amino acids regions selected from positions 80-150, 320-460 or 495-560 of the N-terminal RBP with reference to the lambda stf sequence (SEQ ID NO:1); and wherein said chimeric RBP contains an interaction domain inserted between the N-terminal and C-terminal domain.

16. The bacterial delivery vehicle of claim 13, wherein said N-terminal domain and the C-terminal domain are fused within said region at an insertion site having at least 80% identity with an insertion site selected from the group consisting of amino acids SAGDAS (SEQ ID NO:190), ADAKKS (SEQ ID NO:191), MDETNR (SEQ ID NO:192), SASAAA (SEQ ID NO:193), GAGENS (SEQ ID NO:194), ATLKQI (SEQ ID NO:195), IIQLED (SEQ ID NO:196), GNIIDL (SEQ ID NO:197), IATRV (SEQ ID NO:198), TPGEL (SEQ ID NO:199), GAIIN (SEQ ID NO:200), NQIID (SEQ ID NO:201), GQIVN (SEQ ID NO:202) and VDRAV (SEQ ID NO:203) and wherein said chimeric RBP contains an interaction domain inserted between the N-terminal and C-terminal domain.

17. The bacterial delivery vehicle of claim 13, wherein the C-terminal domain of the different RBP has a depolymerase activity against an encapsulated bacterial strain.

18. The bacterial delivery vehicle of claim 13, wherein the chimeric RBP is selected from the group consisting of:
(i) a chimeric RBP comprising a fusion between the N-terminal domain of a RBP from a lambda bacteriophage and the C-terminal domain of a different RBP and
wherein said N-terminal domain is fused to said C-terminal domain within one amino acid regions 1-150, 320-460 or 495-560 of the N-terminal RBP with reference to the lambda stf sequence (SEQ ID NO:1); and wherein said chimeric RBP contains an interaction domain inserted between the N-terminal and C-terminal domain; and
(ii) a chimeric RBP comprising a fusion between the N-terminal domain of a RBP from a lambda bacteriophage and the C-terminal domain of a different RBP,
wherein said RBP from a lambda bacteriophage and the other RBP have homology in one or more of the three amino acids regions ranging from positions 1-150, 320-460, and 495-560 of the N-terminal RBP with reference to the lambda stf sequence (SEQ ID NO:1); and
wherein said N-terminal domain is fused to said C-terminal domain within one of amino acids regions 1-150, 320-460, or 495-560 of the N-terminal RBP with reference to the lambda stf sequence (SEQ ID NO:1); and wherein said chimeric RBP contains an interaction domain inserted between the N-terminal and C-terminal domain.

19. The bacterial delivery vehicle of claim 11 further comprising a nucleic acid payload comprising a nucleic acid of interest.

20. The bacterial delivery vehicle of claim 19, wherein the nucleic acid of interest is selected from the group consisting of: a Cas nuclease gene, a Cas9 nuclease gene, a guide RNA, a CRISPR locus, a toxin gene, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor and a gene expressing a virulence protein or a virulence factor, a gene encoding a protein of interest, a gene encoding a nuclease that targets cleavage of a host bacterial cell genome or a host bacterial cell plasmid wherein said cleavage optionally occurs in an antibiotic resistant gene, a gene encoding a therapeutic protein, encodes an anti-sense nucleic acid molecule and any combination thereof.

21. A pharmaceutical or veterinary composition comprising one or more of the bacterial delivery vehicles of claim 11 and a pharmaceutically-acceptable carrier.

22. A method for treating a bacterial infection comprising administering to a subject in need of treatment the pharmaceutical or veterinary composition of claim 21, wherein said subject has a disease or disorder caused by bacteria, said disease or disorder selected from the group consisting of: a bacterial infection, a metabolic disorder, and a pathology involving bacteria of the human microbiome wherein administration of the pharmaceutical or veterinary composition results in treatment of the bacterial infection.

23. The composition of claim 21 wherein said composition is for in-situ bacterial production of a compound of interest, said compound of interest being produced inside the targeted bacteria.

24. The composition of claim 23 wherein said produced compound of interest is secreted from the targeted bacteria or expressed on the surface of the targeted bacteria.

25. A nucleic acid molecule encoding the branched-RBP of claim 1, wherein said nucleic acid is a polycistronic nucleic acid molecule.

26. The nucleic acid of claim 25, wherein the polycistronic nucleic acid molecule comprises one or more ribosome binding sites.

27. The engineered branched-RBP of claim 1, wherein the association is a covalent association.

* * * * *